United States Patent 10,888,096 (BIOPESTICIDES FOR POTATO LATE BLIGHT DISEASE) - sequence listing, part 3

SEQ ID NO: 3 - DNA, 6837781 bp, Pseudomonas chlororaphis 189 (residues 3,418,893-5,128,338 of 6,837,781)
ggtagccgtgtggggcgatccaggcctggcgggtgttttcgtccaaggagcgcacgcgcacaggcaggtcgcggtaaggcgcgggattgtcggtgaagacctggatgtcgagggcttcgcccggtgtttcgcgcagcccggccagggcgctggcaatactgaacgcggcttcctggtgataggtcgcggcgccgtaaaccagatagatcaattgtgggcgtgctgcggtgctgcctgtggacatctacggcgatccttcggatgtattgggggttaaaaaaaaggccctggatttcgccaaggccttttctgatgctgtcgggcggttaacgcggcagcttcaggttgttccagacggccaggcttggctcggcttggttcagggtatagaaatgcagccctggcgcaccgccttgcaacaaacgctcacacatttcggtgatgacctgttcgccgaacgcctgaatgctttggctgtcgtcgccgtaggcttccagttgcttgcggatccagcgcgggatttccgcgccgcaggcgtcggagaaacgcgccagcttgctgtagttggtgatcggcatgatgccgggcacgatcgggatgttcacacccatttgttgcacgcgttcgacgaagtagaaataactgtcggcgttgaagaaatactgggtgatcgcactgttggcgccggcgttggccttgcgcacgaagttgttgaggtcgtcttcgaaattacgcgcctgtgggtgcatttccggatacgccgccacttcgatgtggaagtggtcgccagtctcttcacgaatgaagctcaccaggtcgttggcgtgacgcaactcgccgctggccatgcccatgcccgaaggcaggtcgccgcgcagggcgacgatacggttgatgccggcggccttgtactgggtcaacaggccacgcaggtcggccttgctgtcacccacgcaagacaggtgcggtgcggcggggatcttcacttcgctttcgagctgcagcacggtgttcatcgtgcggtcgcgggtcgagccaccggcaccgtaggtgcaggagaagaaatcggggttgtaactggccagctggcgggcagtggcgagcagtttttcatgcccagcatcggtcttggtcgggaagaactcgaagctgtagcgacggtcttgggacatggaggaaacctccagctacaagctgcaagccacaagctgcaagagtagcggaggtgcgctcagctcttgtgcctggaacgggctgcttgaaactgtttaagcaaatagggacgaagccgaaagcttcgagcggcaagcacggcttgtggcctttgcttgccgcttgaagctcaaggcttgcaactgctcttagtaccggtaagcgtgcggcttgaacgggccttcgacggtcacgccgatgtagtcagcctgctgcttggtcagttgggtgaccacgccaccgaagccgcggaccatttccagggccacttcttcgtcgagtttcttgggcagtacttcaacggtcaggcgctcggctttctgggctggcgacaggtcggcgtacttctggccgaacaggaagatctgcgccagaacctggttggcgaacgaaccgtccatgatgcgacttgggtgaccggtggcgttgcccaggttcaccaggcggccttcggccagcaggatcaggtagtcgtcgttctgggcgtcgaaagcgcctgggccggtgcggtgaaccttgtgcacctgcggcttcacttcttcccatgcccagttcttgcgcatgaaagcggtgtcgatttcgttgtcgaagtgaccgatgttgcagacaacggcgcgcttcttcagggccttgagcatgttggcgtcgcaaacattgacgttaccggtggtggtcacgatcaggtcgatcttgcccagcagggccttgtcgatgctcgcttcggtgccggtgttgatgccgtcgatgaacggcgagaccagttcgaaaccgtccatgcaggcttgcatggcgcagatcgggtcgacttcggaaaccttgacgatcatgccttcctgacgcagggactgggccgaacccttgcccacgtcaccgtagccgatgaccagcgcctgcttgccggacaacaggtggtcggtaccgcgcttgatcgcatcgttcaggctgtgacggcagccgtacttgttgtcgttcttgctcttggtcaccgagtcgttgacgttgatggccgggatcttcagctcgcccttggccagcatgtccagcaggcggtgcacgccggtggtggtttcttcggtcacaccgtggacgcgatccagcacctgcgggtacttcttgtgcagcagctcggtcaggtcgccgccgtcgtcgaggatcatgttggcgtcccaaggcttgccatccttgaggatggtctgctccaggcaccactcgtactcttgctcggtctcgcctttccaggcgaataccgggataccggcggcagcgatggaggcagcggcctggtcctgggtcgagaagatgttgcaggacgaccagcgtacttcggcacccagggcaaccagggtttcgatcagcacggcagtctggatggtcatgtggatgcagccgagaatcttcgcgcccttgagcggttgttcagcggcgtacttgcgacgcagacccatcagggccggcatctccgattcggcgatgatggtttcacgacggccccaggcggccagggacatgtcggcgactttgtagtcggtaaaatctgcaggcgtgatgacagcgctcatgaagagcctccattcgtaagtatgcgaatgggcgccgttgtgcgtttagtgactgaccgaaccatcacggccagacaacgccccatccgagcctgacaggtcgaacctgctgcagcgcccctcggacaggtggcgggaaaacggtatcaggtgatcgttaccgttttgaaacggaggcgattatagccgtctgccagcgacttcccaaggatttctgtcggacgatgatcgaacggttatcgcgaccatagtagaagctcaatagagctctgcgccggggtctgccatgatgtcggcatcaatcggcaagacggtcaggagtgagtatgaatttccacacccgcaaatgggtaaaacccgaagacctcaaccccaacggcacgctgttcggcggcagcctgttgcgctggatcgacgaagaagcggcgatctacgccatcgtccagctgggcaaccagcgcgtggtcaccaagtacatttccgaaatcaactttgtcagcgcctcgcgccagggcgacatcatcgagctgggcatcaccgccaccgaattcggccggacctcgatcaccctgacctgtgaagtgcgcaacaagatcacccgcaagagcatcctcaccgtcgagaagatggttttcgtcaacctgggcgaggacggtttgccggctcctcacggtcgtaccgagatccggtacgtgaaagaccagttcaaggacgacgagcccatcgcctgaccgctgtgggcgtgagtctgcctgctcctgcatgagggcactgaacgagccctgaaccccggatgtcgtacctgacagggtacccacaggttcaggagccattaacgtgcagacagacggcaagaccccgggcctttctcccgaagagcagcacgacgtagacaagaaccagccgccccgcgcggcggtcttgcacgagatcatccgcacccagggcgacaaggagctggagcgcagcgtcgcggcgctctggtggtcggccctggccgccggcctgaccatgggcctgtcgctgatgggcatgggcctgctctactcgcgcctgcccgacggcgaagggttcaaggtgattgccagtttcggttactgcgcgggtttcctggcggtgatcctggcgcgccagcaactgttcaccgaaaacaccctgacggccgtgctgccgatcatgagcaaacccaccctgggcaatttcgcgcgcctgtgccgcttgtggggcgtggtcctggtgggcaacctgtgcggcacgctgctggtggcctacgtaatgctgcacctgccgattttcgacgccaggaccgacctggccttcctcgatatcgggcgcaaggtcatggagaacgatgccggacagatgttcgccaagggcatcgtctccggctggatgatcgccaccatggtctggatgatcccgtccatggagagcgccaagatgtggatcatcatcctgatcacctacctgatggccctgggggacttcacccatatcgtggtcggttcggtggaggtctcgtacctggtgttcgccggcgagttgccgtggcgggatttctggtgggtgttcgccgggccgacgctggcggggaacatcatcggcggcagcttcatcttcgccctgatcagccatgcccaggtgcgcagtgaaagtggcctgccaaaaacgactgcggaccctgggcgggtccgcgatcgatcaaaaaacgatcagtgagcgtcctgggtggccgctggtgcatcctgggtgacatggcgcaccagtttgccgatggtcaggccctgcaggaggatcgacgacagcaccacgatgtaggtgatgctcagcaccaggtcgcgctccgggcccaatggcagggccagggccagcgccaccgaaaccccgccgcgcaggccgccccaggtcagcacccggatagtgccgcgcggcacgctgcgccagcggcgtagcaggacgatggccggagccacggtgagcaggcgcgacaacacgatcgccaccgccagcaggctcgcggccagcaggtgcagccagttgaacggcagcagcaacagctccatgccgatcagggcgaacagcagggcgttgagcatgtcgtcgagcagttcccagaagccgtccaggtaacgccgggtcatgtcgttcatcgccaggttgcgccccaggttgccgatgatcaggcctgccaccaccatcgcgatcggtgccgagacgtgcagttcgctggccatcgccgagccgccgatcaccagggtcagcatcacctcgatctggtgctgctcgatgctcttgatcatcaggtacaccaggtagccgatcagcccgccgaacaccacgccgccgatggcctcatgggcaaacagcagggcggtggcgccgatggtcggggtttcgccgagctgggcgatacccagcagcacggtgaacaccaccaccgcggtgccgtcgttgaacagcgactcgccgacgatggtggttttcagcggcttggaagcgttggcggtacgcagcacgccgagcaccgcgatcgggtcggtcggcgagatcagggcgccgaacaacaggcaatagaggaagctcacgtgccagccgaacaggccgaagatccagtaggccaggctgccgatgacgaacgtggcgatcagcacgccgaccgtggccagcaggccgatgggccagcgatagctgcgcaggtcgttgaggttgacgtgcaaggcgccggcgaacagcaggaacgacagcatccagttcatcagcaggtcgccgaagtcgatctggccgatcagctgttgcacatgctcttccaggccgggatagccgaggaagctcaagccttgcagcagcagggaaaacagcagggcggtgaccatcacgccgatggtcggcggcaggccgatgaagcggaagttgacgtaggtgagcagggtggtcaggcagatgaaggcggcaacgagttcaagcatccggagtcccttggatagaaacgtgaaaagaaagcccgaaaaccatcgggcaagggtttgatgggccgctggcgacccggggcacaccgacaaggaaagttcagattcttctgtcggtgagccggtcggacagtgcgcggttctgtaggcgaccgtgggtcagtcgcgcgctcgtcgaggctcagccggatacattgatcgcggccgcctggcgacgttgcaggtgaatgaacagcagcgcggtcagcaccgtcagtccgccgaccagtgcgccggtccacggcaggtcggccaggtcggcgccgctggcgacgaccagcccgccgatccaggcgccggcggcgttacccaggttgaaggcgctctggttcagggtcgagcccaggttgggagcctcgtgggcctggtcgatgatcagcaattgcaggatcgggcacagggcgaaggcgaaaatcccccacagcagcaacgtgatcgccgccgggatcagcaggtggctggtctggctgaacgcggccagcaccagcaccacggccagcgccatggccaccagcgacggcagcaggcggctgtcggccaggcggccgccgagcatgctgccggccgtcaggccgacgccgaacagcagcaacatgatggtcacgccatgggggctgacgccggtgacgtcctgcaggatcggcgcgatataggtgaagacgctgaacaggctggtggaggccagcacgctcatgcccagggccagcagcacgttggtcttgcccaggaccttgaactcgctggccaggttggccttgtccatggcgatgtgccggggcagccagaaccactgggcaatggcggcgagcactccgatcaccgacaccgcccagaaggtcgagcgccagccggcgtattgccccagtgccgtgcccagcggcacgccgagcacattggccagggtcaggccggtgaacatcatggcgatcgcctgggcgcgtttgtttggcgccaccaggctggcggcgaccaccgagccgatgccgaaaaacgcgccgtggcacagcgcggtgatcacccgcgcggccatcagcgtggcatagttcggcgccagcgcgcagagcacgttgccgaggatgaacatcagggtcatgcccagcaacgtggccttgcgcggcatgttggcggtgccgacggcgaggatcggcgcgccgaacaccacgcccagggcataaccggtaatcagcaggccggcatggggaatgctgacggacaggtcacgggcgacatcgggcagcaggcccatgatgacgaattcagtggtgccgatgccgaaggcggcaacagccagtgcgagcaaggcgagtggcatgcgaggattctctgtctgtagtcttgacgccctgatcaggcatacgcatgccagcttgctcctccatcggatcaggtccggcggatcgggcagcggcaggaattattggaatggatatgcgcaactgagtgcggcgtggtcggcgtcagtatagacagccgaggcccttaggtgaatcgattctcttatagcaaacagggagtgtgaggtgctggcgacaactctggttctggtggcggcgctgctgcatgcggcgtggaataccctgatcaagttcagtggtgaacggttattggtggtggcctgcatggacagcgtcgccttgttgttcgtggcattgatgctggggttcgttgagtggccaccgctgcagatctggccgtggatcctggcgtcggcggttttcgagttgctctaccgctacctgctgatccaggcctatcgggtcggcgacctgggcctggtctacccactgatgcgcggcctttcgcctctggtggtgctggccctgaccctgatcttcgcgggcgaggtgctcagtccccagcagatcctcggcatcctgttgatccctttcggcatgctgtgcctgctgtggcagggcggtggcggcgaccgcctgccatggtcgatgttgccggtggtggcgctgatcggcctgtgcatcggttgctacacctttatcgacggccaggcattgcgccgctggtcccatccgctggattacctggtgtgggtgacgctgctcagcgcctggccctttccgttgctggcgctgctgcgcaagcgtgcggccttcagcctgttctggcgcgaacaatggaggctggggttgagcgtcgggttctgcgtattgttcagctacgctctggtgctgtgggccatgcagctgggatcgatcgccgaggcggcggcgctgcgggaaatcagcgtgatcctggtggtgctgttcggcatgcgttacctgaaagaacctttcggccggcctcggctcttagcttgtgggctggtgctgatcggcatgctggtgatgaagttctgaccccgctcccctcatgactttaaaaaggactctgccatgaccgtcgctttctggtgtgtattgatcgccatcttcctgccgtacctgtgcaacagcatcgccaagttcagcgggggcgactttggcctgcggcagaaccatgacccgcgggcctacctcgaaaccctcgagggtttcgcccggcgagcgcaagcggcgcagctcaacagttttgaagtgaccccggcctttgccgcgggggtgatcattgcccacatcgccaacgtcgccgaactggtgaccatcgatgtgctggcggtgctgttcatcaccagccgcctgctgtacatcatctgctacctggcggactgggcgatcctgcgctcgctggtgtggctcgtcggcatggcgctgattgccagcttctttttcgtctcgatctgatcctgtagccgctgccgagcccgcgaagctgcgctcgggcgtgcagcaggcgcggttatcctgaccccgcgcattctcaggttttgcgcctgctacgcagtcgatcgcagcctcgcgggctcggcagcggctacggggctacagggtcatttgctgtcggtgacttcaggcactttcggcagcgtggcgcccttgggccagagcatccagatctggccctgctgtttcatgtctcccgccagttgcccggccgcgtcgccggtgccccagaacaggtcggcgcgaacttcgccggcgatcgcgccaccggtgtcctgtgccgccaccgggcggatcaggctgctgccatccggccgggtggtggaaagccacaacaggctgcccagggggatcaccttgcggtccactgccacgctgtagccggacgtcagcggtacgttcaacgagccgcgcgggccttcgttgctgtccgggttgcggttgaagaacacgtagctggggttgctgcccagcagttccgggatgcgattggggttggccttggcccaggccgcgatggtgcccatggtcacgtcttctttcttcagctcgccctgatccaccagccagcggccgatggggcggtaggggtggccgttctggtcggcatagccgatgcgcaactggcgcccgtcttccagctggatgcggcccgagccctggatctgcaggaattgcaggttcatcgggtcggtcagccaggcgatcaccggcgccttgactcccttggtctcgatggtcgcggcatcgtcgtagggtttcagcacccggccttcgaggcggccgcgcaggcgcttgcccttgagttcgggataaatgctgtcgagggcgacgatgatcatgtcttccggcacgccatagactggcactgacgcagcctgggtctgggtcaggctgcccggatagaccggctcgtagtagccggtgatcaggccattgctgctgccgctggccgagcgcaggccgtagacgtccaggtgctgcttgagaaagctgcggacatcgagggcggtgagcggcacattggccgccgtcgcgcaggtcgggccccacaccgggtcggctttcagtcgggtgcaggcgctgcgccaggaaccgaagccggccagcaggtcgtcgtcggacacagtgggcaaggcttcccagctggcgctggtataggtggcaatggcatggggctggggtggcttgccgacttcgccgccattgcatccggccagcaggatcgcggtcggcaaggcccaggccaggtgtcgacgccacagcttgaaacgggtgttcattgggtacttcctttgtggcttgcctgggcgcatggcaacgtcaggcaatccatattgttaatagggctattggtctttgccggacaggcgaggatactggcggccgtttcccgtgacccgaagccaccatgacgcttaaaagactctctgttgtattgctggcctgcctgacgctgtccgcctgcggcggtgtcgatccgaactccccgctgggtcagcgcaaggcgatcttcaaacagatgctcaagaccggtgaagacctgggcggcatgctccgtgggcgtatcccgttcgacggcccgcgctttaccgaaggcgcgatcaagctggacaacctgtcccacgaaccctggaagcatttcccgcaggtcaaggaacaggagcacaccagcgcgactgacgatgtctggcagaagcaggcacgtttctaggaactggcccgcacccttgaggcggccaccggtgaactggtcatcgccagcaaggtccagccgtacaaggccagcaacctggggccggcggtacagaaagtcgaagatgcctgcagcgcctgccataaagagtttcgcgatcactgatcctgtcgcctgaggtgtctgcggcaggcacatctgccgcggcggctcgaacttacttgtccagttcgtcgagggcttcctgcaattccttgcgggactcggccagcttgtccttgcgcttgttgatcttctcggcgtcgccttttttcatggccttgtccaggtcggtctggcgccggctgacttcgtgcttggcgtccagcaccttgttttcgcgttcctttttcagcgaggcgtcggtgcagttcgcggtggcttcgctcagggctttttccaggccggcctgttgttcgctgttgccgtgggccttggcctgttcgagctgggtgctgatggcctggcgcttggcggcgcagccggtgagttccggggcctgctcggcggccatcagggctggggttgtcagggcgaatgcggcgaagagggtgagcggtgcaagaaatttcataaaggctccatgtgaaaagatgaatagcaggagtggggcgacgggctgtttgagccatctgcgtccccggggttcaacgccgccggctgtaaaagcctcagaagccttcgattccggcggcacgtaattcttcactcaaggccaggacctgcggatcgcggaagaaggcgctcaactgagcggcgcgtcccgggccgatagcgctttgggcctgccattgttcggtggttctggccgccaacgccgcccagccatcttcgagcctggcatcgccggtcggtggcagtccaagggctttgagccagcgctgaaacggctgccggcgggcgctgtgcaggctgctcagcaaacgcgcgatgctgcgttcgccaaggccggtaatgttagcaagctctgcaggttcaagggtcaaccaatcgaccaagccgttgatcagtccggcgtccaccagcttctcccaggtgccggggccgacatggggcaggtccagcccggacttgccgctcagccaggtcaagcgtgcgaggaactggctctcacagccgggccgggggtgccagcaactgagcgcatggaaggccgaggcatccggaacctgcagcggaacacgctggggcgtgcgcagtatcaccgcgttcaggcgcgggatggtcaggccggcgaggctgatcgatacctggtcgccagggcggatatccagtttctgccagcgcggcagcgagccgacgctgacccgtctgatctgccggtcgtcgagcaggaccggctccagttcgagcatcggggtgatccggccagtgcggccgatcttgaagtcgaccttgcgcaccctggccagggcctgggcgaacgggtatttccacgcggcgatccagtagggcgccttggcctgccagcgttgcgcctctgggcgtcggctctggcgcaggacgatgccatcgctggcgaagggcagggccgagcgataccagtgctctcgccagtgccggacctcggcgaacgtactgacgcgctggctgtactcgctgctgtgggcaaaccccagggccttgaggccggccaggcgctgcgccagagtgctcgggccttgtggccagtcccagacgaacaggccgatccggctggcttgccgagggtccagctggttgcgcgccaataggccggcaacctggccgcgggcattcaggctgccagccttggcctgtatgtgatcgttctggcgccaatagagctcgccctgtagcagcaggtcccgaggttcgggcaggcgtttggggatggcgcttatcagttgcgcgggcccggtccagtcctggccctgaaggccatccccgcggctgatggcttgctggaagcgtccctggcgatagatcagggtcacggccacgccgtcgatcttgggctgtacccagacctcctcgcgcccggcgagccactggcgtacggcactttcatcggccagtttctccacgccggtatggggaatggggtgcgggacagtaccgcgtgcggtgcgtagcgggttggcgcggtctgcactgacggtggggaaacagctttgccaatgttcgagccgggcgcgggactggtcgtagagctcgtcagtcaccggcgacaggccttcacggtggtagctgtcgtcccagcgattgatttgctgttgcagggtggccgtttcggtttgcgcctgggcaggtgtccagtcggggcacgggctggcgacgcttggcagggcgatggcgctcaggaggattgcggccaatagcgttgctctgtagggcatggggagcatccttgctcggggagtcaggttgcaggctagaggggtggacaggagggagaaagggcgtatggattgccgggtatttcgtgggccggttggactatgcgccggttttttcgcgagccggcttatacccctgggaatcaggctgaccccgtaggagcgccctgcaaatcatgaaaccttcagccacaaaaaagccccgcaagggcgaaccttgcagggcttgggtaagtgctgccgggattacaggttggcagcggcgcgcagggcttcggcgcggtcggtcttttcccaggtgaaggtggtgaaggtgtcatcacccacggtcttggtttgcggggtacggccgaagtggccgtaggccgcggtttcgcggtacatcgggtgcagcaggtcgagcatggtggtgatcgcgtacggacgcaggtcgaacacttcgcgcaccagcttgatgatcttgtcgtcgctgatcttgccggtgccgaaggtgttcagcgagatcgaagtcggttgcgccacgccgatggcgtaggacacctggatctcgcagcgctcggccaggccggcggcgacgatgttcttggccacgtaacgaccggcgtaggcggccgagcggtcgaccttcgatgggtccttgccggagaacgcgccgccgccgtgacgggccatgccgccgtagctgtcgacgatgatcttgcgaccggtcaggccgcagtcgccgaccgggccgccgatgatgaactggccagtcgggttgatgtggaactgggtgtccttggacagcagttcggccggcagcacgtgcttgacgatcagttccatcacgccttcgcgcaggtctttgtacgacacgtcagggttgtgctgggtcgacaggaccacggcgtcgatgccgaccaccttgccgccttcgtagcggcaggtgacctgggacttggcatccggacgcaaccacggcagcaggccggacttgcgggcttcggcctggcgctgcaccagttggtgcgagaaggtgatcggggccggcatcagcacgtcggtttcgttgctggcgtagccgaacatcaggccctggtcgccggcgccctggtcttcaggcttggcgcggtcgacaccctggttgatgtcgggggactgcttgccgatgatgttcatcacgccgcaggtcgcaccgtcgaagccgacgtcggagctggtgtagccgatgtcggtgatgacgtcacgaacgatctgctccaggtcaacccaggccgaggtggtgacttcgccggcgacgatggccacaccggtcttgaccagggtttccaccgcaacgcgggcgtgcttgtcctgggcaatgatggcgtccagcaccgcatcggaaatctggtcggcgattttgtccggatgcccttcagacacggactcggaggtgaaaagggagtattcgctcatctcgacggtttcctaaaatttaccgatggtgagtgtcgccagccggtcgctgaaagtggcggacctggatctggaaaccattacgtaaacctacatacagactttctccgggaaccagtcccgcagcggtggcccagcgggccagatcatcctggtcaaaccccagccagagatcaccgcaggcctccctggcccaactctggttgtggctgcacaactctgtcactaacaggctgccgcccggttgcagcaagccggccaagcgtttcagcgcatcggccggcgcggcgaaatggtgcaggaccatgttcagcaccacgcaatcggccgtcaggctcgcgccattcaatgcatcggccagttgcaggctgacgttagccagcgtttcgcgctcacagacctggcgtgccagttcgagcatggccgggctgttgtccaacgcggtcacccgggcgaaacgacgggccagttccggcaggaaactgccatccccggggccgacttcgatcgccgtggcggtgtccgtgaagttcagtttgtcgagcagtgccagcacgctttcgcggtactggggcagtcctgcgatcaggtcctgctgggcgcgaaatttctccgcgacccgtgagaaaaagtcctggctggcggccgcccgctggcggtgcaccaggccgatacgcgattgcacttcgccgggcagcgtcaggttgtccacttcatccagcagggcggcgtgcagcctgccgcccagcagttcggtgtggggcagggcgcgtcggtagaagatcgcgttgccttcgcggcgggttgccaccaggtcggcctgggccaggaccttcaggtggtggctcatgccggactggccgatggcgaagatctgcgccagttccagtacgccgaacgagtcgttggccagcgcgcgcaacacattcagccgcagcggatcgccgccggccttgcacagggccgccagctcgtcgcagtcgtcatggttcatggagggcgcgcgtaaattcataaggccagcagtctagtgacgcacccccaacctcgcaagaccaatatcaaaaagttttgatattgctcgatagatggcacttaacgcaggtccctgtgttctacaaacgaactgcggaatggtttcatcaggcgattgcccctttatcgaccggaaaaacgcgccagagtcactatctgtcattgcccccgcctaccggctgagggaaaatgcacgcctttttccgattcgtttttattcaacccgacttagataacccccaggagatcagcgatgccaagccgtcgtgagcgtgccaacgccattcgtgccctcagcatggatgccgtgcaaaaagccaacagcggccatcccggcgcccccatggggatggcggatatcgccgaagtactttggcgtgactatctgaagcacaacccgagcaatccatccttcgccgaccgtgaccgcttcgtgctgtccaacggccacggctcgatgctgatctactcgctgctgcacctgaccggctacgacgtcaccatcgacgacctgaagagtttccgccagctgcacagccgcaccccgggccatccggaattcggctacaccccgggcgtcgagaccaccaccggcccgctgggccagggtctggccaacgccgtgggcttcgccctggcggaaaaggtcctggcggcgcagttcaaccgtccagggcacaacgtcgtcgaccaccacacctacgtgttcctgggtgatggctgcatgatggaaggcatttcccatgaagtcgcttccctggccggcaccctgggcctgggcaagctgatcgccttctacgatgacaacggcatctccatcgacggcgaagtcgaaggctggttcaccgacgacacgccaaagcgtttcgaggcctacaactggcaggtgatccgcaacgtcgacggtcacgacccggaagagatcaagaccgcgatcgacaccgcgcgcaaaagcgagcagccgaccctgatctgctgcaagaccaccatcggcttcggttcgccgaacaagcaaggcaaggaagactgccacggcgcgccactgggcgccgaggaaatcgccctgacccgcgccgcgctgaagtggaaccacggcccgttcgaaatcccggtcgacatctatgccgagtgggatgccaaggaagccggtcgcgccgtcgaagccgagtgggaccagcgtttctccgcctactccgccgaattccccgagctggccaacgagctggtgcgtcgcctgagcggcgacctgccggccgatttctccgagaaggccgacgcctacatcgccgaagttgcggccaagggcgaaaccatcgccagccgtaaggccagccagaacgccctgaacgcgttcggcccgctgctgccggaattcctcggcggctcggccgacctggccggttccaacctgaccctgtggaaaggctgcaagggcgtcagcgccgaagacgccagcggcaactacatgtactacggcgttcgcgagttcggcatgaccgccatcatgaacggcgtggccctgcacggcggcctggtgccttacggcgcgaccttcctgatgttcatggaatacgcgcgcaacgcggtacgcatgtcggccctgatgaagcagcgcgtgatccatgtctacacccacgactccatcggtctgggcgaagacggcccgacgcaccagccgatcgagcagatcgccagcctgcgctgcaccccgaaccttgacacctggcgtccagccgatgccgtggaatcggcggtggcctggaaaaacgcgatcgagcgcaaggacggcccttcggcgctgatcttctcccgtcagaacctgcagcatcagacccgcaatgccgtgcagatcgccgaaatcagccgcggcggctacgtgctcaaggactgcgcaggcgagcctgagctgatcctgatcgccaccggttccgaagtcggcctggcggtgcaggctttcgacaagctgaccgagcagggccgcaaggtgcgcgtggtgtccatgccatgcaccagcgtgttcgatgcccaggacgccggctacaagcagtcggtcctgccgctgcaggtcagcgcgcgtatcgccatcgaggccgcacacgcggactactggtacaagtacgtcggcctggaaggtcgcgtcatcggcatgaccacctacggcgagtcggcgcctgcgccggccttgttcgaagagttcggtttcaccctggaaaacatcctgggtcaggccgaagagctgctggaagactaaagaagcgcgaatgcggtggcctctggtcgccgcatcactttgtaggagcgagcttgctcgcgatggtcgtcaacgataacgctggctatctggataaccgtgtcgtcctgaagtccatcgcgagcaagctcgctcctgcaatggttttgtatcgctcatgaagttgtcggctaacgagaaccccatgcctcaaccgcgtccctacaaagttgcactcaacggctacggccggatcggtcgttgtgtcttgcgtgccctgttcgaacggggggctgcggccgggttcgagattgtcgcgatcaacgatctggccgacatggccagcgtggaatacctgacacgcttcgactccacccacggccggtttcccggcgaagtgaaggtcgacggcgactgtctgcatatcaatggcaactgcgtgaaggtcctgcgcagtgccacccccgaaggcatcgattgggcgtccctgggcgtcgatctggtgctcgaatgctccggcgcctatcacacccgtgaagacggccagcgttttctcgacgccggtgcgccgcgggtgctgttttcccagccgatggccagcgaggcggatgtcgacgccaccatcgtctacggcgtcaaccaggactgcctgaccggcgacgagctgctggtgtccaacgcgtcctgcaccaccaattgcggcgtgccgctgttgcgcctgctggaccaggccattggcctggaatacgtgtcgatcaccaccatccactcggcgatgaacgaccagccggtgatcgacgcctatcaccatgaagacctgcgccgcacccgttcggcgttccagtcggtgatcccggtgtccactggtctggcgcgcggtatcgaacggctgctgccggaacttgccgggcgaattcaggccaaagctgtgcgcgtgccgaccgtcaacgtgtcctgcctcgacatcacgatgcagaccgtgagcgataccgacaccggcgaagtcaaccggatcctgcgtgaggccgccaccagcggtccgctcaagggcctgttggcctacaccgagttgccgcacgccagttgtgatttcaaccatgatccgcattcggcgatcgtcgatgccagccagacccgtgtttccggcccgcggctggtgaacatcctggcctggttcgacaacgaatggggttttgccaaccgaatgctggacgttgcaggacactatctgcaaacagccgcacccaaagctgtctcttaacttcccgtttccaaaaaaacagtaacccaggaattgcgacccatgaccgtgttgaagatgtccgacctcgatctgcaaggtaagcgcgtactgatccgcgaagacctcaacgtcccagtcaaggacggtgttgtcaccagcgatgcgcgtatcctggcttcgctgccgaccatcaagctggccctggaaaaaggcgcggccgtgatggtctgctcgcacctcggccgtccgaccgaaggcgagttctccgccgagaacagcctcaagccagtggccgactacctgagccgtgccctgggtcgtgaagtgccgctggtggccgactacctgggcggcgtcgacgtcaaggccggcgacatcgtgctgttcgagaacgtgcgcttcaacaagggcgagaaaaagaacgccgacgagctggcccggcaatacgccgccctgtgcgacgtgttcgtgatggacgccttcggcaccgcgcaccgcgccgagggttcgacccacggcgtggccaagttcgccaaggtcgccgctgccggcccgctgctggccgccgagctggacgcgctgggcaaggccctgggcgccccggccaagccgatggccgctatcgtcgccggctccaaggtctcgaccaagctcgacgtcctcaacagcctgagccagatctgcgaccaactgatcgtcggcggcggcatcgccaacaccttcctcgccgctgccggtcacccggtcggcaagtcgctgtacgagccggacctgctggataccgcgcgcgccattgccgccaaggtcagcgtgccgctgccggtggacgtggtagtggccaaggagttcgccgaaagcgcgaccgccaccgtcaagctgattgccgaggtggcggccgacgacatgatcctggacatcggcccacaaaccgcggcgaatttcgccgagctgctgaagtcgtccaagaccatcctgtggaacggtccggtcggcgtgttcgagttcgaccagttcggtaacggtaccaaggtgctggcccaggctatcgcggagagcgcggcgttctccatcgccggcggcggcgacaccctggcggccatcgataaatatggcgtggccgagcaaatctcctacatttctaccggcggtggcgctttcctcgaattcgtcgagggcaaggtgctgccggcggtcgaagtcctggaaagccgggccaaagcctgaagtcccgatggccaggcaaaggagtgttcatatggtcaagacgttaccgctgttgatcgtcgcgggcttgctggccggttgcggcagccagcctgcccagccggagcccgagtcgggagagcctgagagaggttgctatcaggccgactggcaggccgagaccgcgcctgtgatcaacaagcgcatggggcccgatggtctggacaagtacgagactccagccaaggccaaggaacatggttgcccttgacgggtctgattcgataacgcgttgtgctggcggccgtgggccgtcagccgaggaacaccgatgaaaggctttatcgccgtggctgcgctgggattgctggcaggttgcgccaacttcgacctgttcaagccggccgagacggacaactggacgacctgggtgtgcgacagccaggcgcaagtggtctggcgctacaccgacagcagccgcaaggaagtcgatgtgcggttgggcggggccgatcaggtctatcgcctgaagctggagccgagcggttccggttcgctgtacagcaacgacatgctggcgtttcacgaaaaaggtgacgaaggcctggtttactgggtcgccaccaacgatttgatcggccgcggctgtaaagcgccgtaggcctgtaggagcgagcttgctcgcgatgatcgtcaacgataacgccatccgtctggatgatcgcgttgtcccgaagcccatcgcgagcgagctcgctcctacagtagtaataatgccggcaggccgggctgacccccgatctgcaatcacttgaatagcagccgccgctacggcaggcttgcacgattaacgaccctcgaccgggagagatacacacaatggcactcatcagcatgcgccagatgctggaccacgcagccgaattcggctacggcgttccagccttcaacgtcaacaaccttgaacagatgcgcgccatcatggaagccgctgacaagactgactctccggtgatcgtccaggcttcggccggtgcccgcaaatacgccggcgcgcctttcctgcgccacctgatcctggcggcgatcgaagaattcccgcatatcccggtgtgcatgcaccaggaccatggcaccagccctgacgtctgccagcgttcgatccagctgggcttctcctcggtcatgatggacggctccctcggcgaagacggcaagaccccgaccgactacgagtacaacgttcgcgtgacccagcagaccgtggccatggctcacgcctgcggcgtttcggtggaaggcgagctgggctgcctgggttccctggaaaccggcatggccggtgaagaagacggcatcggcgccgaaggcgtgctggaccacagccagatgctgaccgacccggaagaagccgcggacttcgtcaagaagacccaggtcgacgccctggctatcgccatcggtaccagccacggtgcctacaagttcaccaagccgcctaccggcgacgtgctggccatcgaccgcatcaaagagatccacaagcgcatccccaacacccacctggtgatgcatggttcgtcttcggtgccgcaagagtggctggcgatcatcaaccagtacggcggcgacatcaaagaaacctacggcgtgccggttgaagaaatcgtcgaaggcatcaagtacggcgtgcgcaaggtcaacatcgataccgacctgcgcctggcgtccaccggtgcgatgcgtcgcctgatggccaccaacccgagcgagttcgacccgcgcaagttcttcggcgccaccgtgaccgccatgcgcgacgtgtgcatcgcccgttacgaagccttcggcaccgctggcaacgcctcgaagatcaagccgatctccctggaagcgatgttccagcgttacctcaaaggtgagctgaacgccaaggtcaactaagccttagcgtttcacaaaaaagcccgcagcgatgcgggcttttttgtgcctgtcatccggatggagtggccttgcgctattatttggccgactatccagggagccatcatgttagtatcgacgctgttttgattcgggctggacgatacagaaatcctgctttcttaaagtcgaatgtagtcgtgtcaggtagtacatgaagatttttttcctgggctggacggctcaatacgagcgtcggatgattgattatttgtccacccgacacagcgcgaggttgatggtcttcccttcgacggccaagagaatgggccgctacatcaagtcgatcaacaaaaggctacgccatccaagagtgggcattggctggcttgggaagctggtgctttcgatcaaccgggtggggcgcgacgacatcctggtttgcaacgaggggcaggtgaaacggggcttgattcccagtgtcatcgccagtttcaccggcaagaaagtgttgttgatgcgcgatctggtggacgcggactttgtccgggaaatgcatcggcatttcgatcgtatctatagcttcgacaaagaccagtgcgctgctttcggcatggagtacatggagcagtttttccccttcggattccacgaaatgcaagggctggtcgacgccgcgacggcgaacgagcacgcgccaaaatgcttctttcttggacaggacaagcggcgtgtcgccaggattgaggccatggcgcaggcgcttgagcatgaaggtgcgagcgtcgatttcgccatcgtccgggacagtacctcgaaggaacactccaggttccatatcgacaaggtcctgacatatgacgacaacatccgccgatcgctcgcggcggatgtgctgctggaagtcaatcaggacggccagtcgggcctgacgctgagagcactcgaggcagctttcttcaacaagaagctgatcaccaccaacgagtcgataaagaccctggatttctaccggccggaaaacatattcgtcaccgtggatggctcgcttccgggcgtcggcagctttctgaggggaaaatcggtcaaagtggatcgggacatcctatgcagatacacccctgaccgtatgctcgaacgcatcatcgaagacgttggcgccatgcgctaggctcgataaggcgttggccaccccttgagaaaaaaccgcagcgatgcggtttttctgtacctgtctcccgacatgcctcacgtatctgccattcgcgggagcgtcaggtcgggttgtgatcgatatccagcttgtagaaggtcaccttgccgccttcggtggtgtagccggtgttgtcctgcacgtacaccccggctttgaagtacagcggcttgtcgcgccaggtgctgctgagctgggtgtcccattgatagcccgcggcgctgacgcccagggcgccgcccgggctcaggtggatcaggtaggagaactcgcgatccagcggcacgttttcggcgacgatgatcacccggctatcggtatcgtccgggtgcatgcggaccttggcgactatgttgccgctctgggtggtggtcttgtactggtactcgaccttcaccaggggcttggtgctgttgtaggcgtggatctggccgatgacgatcttgcccgtggacggcacctggttcaccgccagggtggcgtagagcaggttgtcggcttccgggtaggtccagttcttcagggtgccgttggagtaggtttcacgcagctcgctgcgtgggtagatggcgttggcggtgcgggaaccggtgacgggcgaccagaagaacagggtgccggtgtcggaatggaaatattgatccttgaagccctccaccagtcggggggtgtcgatagtcgccggtggactgccttcgggaatgctcagattccaggttgcgaggtcgatcatagtcaaagcttcccgatttgatgccggataaaaaagccgacaaaggctttagcctgcgcttttgaaggcgatctttataagcgtagaagggacttttgttaatgcccgtccggcggataattggcgtcaaccatctgtcgaaaaaacgcttccaccggtttcagcagctatggagctgaccgttagtcgggtgcctcgggctttggctaaatgatggcgctgtgacagcttctgctttattggatccagggctagagtgaagtcacagtatttgtccggtcttgttcgcaggccgaccctacacagacaagagaagcagcatggaatgcgcgcaaactcggccaggtgaagccagctcggtcttactgattgttgatgattaccccgaaaatctgctcagcatgcgagcactcctgcagcgccacgactggcaggtcatgaccgccgcctcgggtgtcgaggccctggggctgttactggaacacgagatcgatctggtgttgctggatgtacagatgccggaaatggacggtttcgaagtcgcccgcctgatgcgcggcagccagcgaacccgcctgaccccgatcattttcctcaccgccaacgagcagtccaagaatgcggtgatcaagggctacgccagcggcgcggtggattatctgttcaagccgttcgatccgcagatcctcaagcccaaggtgcaggcgctactggagcagcagcgcaatcgccgcgcgctgcagcgcctgagccatgacctggagagtgccagggccttcaatgcctcggtgctggacaacgccgcggaggggattctggtagtggatgagggcggggtcatccgctttgccaacccggcgatttcacgcttgctcaacgctccggtgaatgagctggagggggcgtggctgctcgactatctgcaaaagccccatgtgccgcagtgggccgaatccgagctgtatgccagctatcgcaagggcgagacctaccgcctgcacgacgcaacgttgcgtacggcttcgggccagcaggtgtcggtggcgttgtcctgtgcgccgctgccgagcgagcagaaggcgatggtggtgaccctgctcgacatgtcggaagtccgtcatctgcaccagcaactggagtaccaggcagtgaccgatccgctgaccggcctgctcaaccgtcgtggcttctaccagaccgtggagagcctgttgttgcgcagcgagcgctccgacaagtcgctggtgctgctgtacctggacctggacggtttcaagcgggtcaacgattccctggggcatgacgccggggaccgggtgctgcgctgggtgtccgaacagataaaggcctgcctgcgttccttcgacatcctggcgcgcatgggcggcgatgaattcaccgccttgctggagctggagtttccggaacaggcggcgaagatttccgagaagctcatcgagcgcatatcgatctgtcagcagttcgatggcctggaggtcgcgctgggggccagtatcggtatcgccacctaccccgattgcggttccaacctggatggcctgatgcgcgcggcggacatcgccatgtacgagtccaagcgtgccggacgccagcaatatcgttattacgaccacgaaatgaacggccgtgcccgctcgcggctgatgctcgaggaaagtgtgcgcagcgcggtcgagcacaaggagttcaacctggtgtaccagccccaggtggcgattgccgatgggcgcctgcgtggtttcgaagccctgttgcgctggcggcatccgagcgtcggcgatgtgccgccggggttgtttctgccgctgctggaggaggcgcggctgatcagccgcctgggctgctggatctatcagcagagtgcgagccagcgggcgtcctggaaaacgctgttcgccgaacagaccgtgctgggcgtgagtttgagcggcacccagttcgccatgccgaacctcgccaccgaactgcgccaggtcctggagcgccatggcctggaacctcggcagttggaggtcgaaatcaccgaagacgccttgacccagaacctcgacgagtcgcgcaagcagctgcgcctgttgcgcagtctcggggtgcgggtggcgctggatgacttcggttcgggcgcctgttcgctggcccacctgcgggatctggagctcgacaccctcaagctcgaccgtcacctgatcgccaggttgccggattcggcacgggatgcggcgctggcgcgctgcgtgatcgacctgtgcaaggcgttcggcgtgctggtgatcgccgagggcgtggagaccctggagcagtaccgctggctgcaggccaacggctgcgagtacgtgcagggcttcctggtggcgcggccgttgatcgccgcggatgccgagcgctttgccgagcctttcgactggagcgcgttgccgggttgaattcgctacactggcggcctttcgtgattgcgttgccgccccatgaccgcgttgaaatacctccaggcctatcccgccaccctgcaagagcaagtgcgccagctgattgcgcaagggcggctgggcgattacctgagccagcggtaccccggcaagcacggggtgcagagcgacaaggcgctgtacggctatgccctggagttgaagcaggagtacctgcgcaacgccccggccatcgacaaggtgctgttcgacaaccgcctggacctgacgcaccgcgccctgggcctgcacaccacgatctcgcgggtccagggcggcaagctcaaggccaagaaggaaatccgcatcgcttcgctgttcaaggaggcggcgccggagttcctgcgcatgatcgttgtccacgagctggcgcacttcaaggaaagcgagcacaacaaggcgttctacaagctctgcgagcacatgctgccgggctatcaccaactggaattcgacctgcgggtctacctgacctggcgcgacctgcaagccagggcaggtggttccgagtaaccctgtacaaggaacgggcgatggacgtgagcaagaccaagagcagcttttaccgccggctgtatgtggcgtacctgatcgacagcggcctggccagcaatgtcccggccttgaccgaggccaccggcatgccgcggcgcacggcgcaggacaccatcgccgccctggcggatctggatatcgtctgtgagttcgagcagcaggacggcgcgcgcaatcatgccggcagctatcggatcaaaagctggggcgcgatcgacaagggttggatcgaagcgaacctgtcgcggatcaagacggtgctggagtatccctgaggggttcgcggcggtcggtcgatcctgtcgcgagcaagctcgctcctacaggatttgtgccgtccctgtaggagcgagcttgctcgcgatagcgttctcaggcccggcgcatgccgatatggggaatatcgtcttccaggtactcctcgcctacgacgttgaagccgtagcgcccgtaatacccctgcaaatgcgcctgggccgacagatagatcggtatgtgcggccagtgtttctgcgcctgtttcagggcgtgctccatcagttcatggcccagccccttgccccgcgcttgcggggcgatcaccacgcggccgatgaccacgtcgccgccctgggaggtcgggtcgagcaggcgcagataagccaccagctggtcatcgtcccaggccatcaagtggcaggtgtcaccttccaggtcctggccatcgacttcctggtaggcgcatttctgctcgaccacgaagacttcggtacgcaaccgtagaatcgcgtacagctgctccttgcccagatcggtatggtgtttgcagacccattcgattgtcatcgtttcatcctttggaaagcggtgcccggatgttaagcgcctggcgggtggcttgtcttgcccggcgctggagtggcgtttctgtgaggtaggtcaaaatgccatcatcgcattggttcgcggcggtcttctttgtgtaatctgcgctgaggcgctgtgcagtggcgtccataagctactgttaggagctgggtcgcggccgtccaccggccggagaacctcgagtctgggcaaaaaaacacgcagggctgtccgcccgctaaggatcttttagcatgccgcgattgcatcgagcttttgctttgatcggattgctgttgctgggccagagcgtttatgcggaaaaattgcgattggtcgccgacgcctggccgcccttcacggatgcgacgctggtcaacggcgggctggccaccgacatcgtcagcaccgcgctggcccgggccggctatgccagcgagttcgaacaggtgccctgggcgcgggccttgcttggcgtcggcgaggggcgttacgacgtgctggtgaatgcctggttcaatgaggcccgcacccagctggggcagttctcctcggagtacctggtcaatcgggtgcgtttcatccggcgcaaggatgcccccattgaatacaccaccctcaagcaactgcaccagtaccccatcgcggtggtgcgcggttatgcctactcccccgatttcgacagcgatccacagctgcagaaggtcctggtgcacaacttcgcgatggcggtgcgcatgctggcagccgaccgggtcaagctgaccctggaggacgagtacgtcgcccgctattacctggcgcgggaatcgccgcgggtgcgtaacgcggtggagttcctgcccaattccctgagcgagaacggcctgcatatcctggtcagcctgaagaaccccgcgcatgcgcagatcgtggcggggttcgatcgagagatcgaagcgatgaaagccgacggcagctacgaccgcttgctgcgccagcatgggatgtgagacggcgccattaaagctgctgccgcaggctgggcgccgaggccaaaacctgcggcgttcttgaaagcttgcgcctcctgcggcagcggctacgcggcctgttcttcgccggtgtccttgatcagatgcgctgccagggtccgcaaggggcccagttggcggcagatcagcgccagttgggtctgcactagccgctggccttcatcgatctcgtccggcatctgctccagctcattggccagggcttcttcggcatcgctctggatcgccaccggctgcttgctcgccaggccctgggcgatttcatcgatgctgctggccaggctgaccccggccccgtcgatcaggtgctcgcggacttccgccggcagttgggtttcccgatgcgcgccgaggccggagaggtaactgagcagggtgtgcgagagcaccaggaagcgaaagcccacgtccgcttccttacggaaatgcccgggctccatcagcatgttggccagggtggtggacagcgccgcgtcggcgttgtgggcgttgcgccgggccaggcggtacgccaggtcgtcgctcttgccggccgcgtactgctgcatgatctgccgcaggtagatgctgttgcaggtcagggtattggccagcaccttgttcaggcgtcggccctgccagtccggcaggaacaggaacaccgccaggccggcgatcaggctgcccagcagggtatcgaacaggcgcggcagcaacagcccgtagccgtcgcccacctggttgaagcagaacagcaccatgatggtgatggcgccggtggccagggtgtagcgggtagtgcggttggtaaagaacaccaccccggcggcaatcgcgaacagcgactgcaccagcgggctggggaacaggtcgaacagcgcccaggcgacgaccaggccgatggcggtgccgatgatccgctggcccagcttgcgccgcgtggcgccatagttcggctggcagacgaacagggtggtgaggatgatccagtaaccctgggaggggtggatcaggtgcaccatgccgtagccgatgctcagggccaggggcaggcgcagggcgtggcgaaacagcagcgacgtcggggtcagctgggtgcgcaggcgggtccagacgtccttgaggttgcgcggcgaacgatccagcaggctgctgtcggtggcgtcggcgagggcgtcggggttgctggcgtcactgagcaggcggtcgagggtgccgaggttggcggccagcgcccgcagcgaacgcagcaggccgcgccaggccgggttgctctggatgcgcaggtgttccagggaggcgtgcaggtcgctcagggcttcggcgaagctggcgtcgtagacgaagggctggcgcagctggatggattcgcccagggcccggcaagccttgccctgctggcgcagcaggcgctggcagcggaacagtacgtcgctgtggaagaacgcatcggccagggcgttgtaggggtagtgggacgagctggcacgttcgtggatgtcctgggcgaggaagtacagcttcaggtagcggctgactttcgagcccggccggccgttgccgacccggtgcaggatgatttccttggcggcgttcagggccgccactacccggccgttctgctgcgccagttccagccggcgtgcttccacgtccagctggcggatcggctcgaacagcgacgacttgagcttgaggtaatagcccagctcgcggaacaggcgcgccaggctctgctgcaccggctggttggaaaacatcgcctgccacagtaccgacagcaggccataccaggcggcgccggccaccagcagcagcggttcgtgccagaagtcggtgacggcgccgccgcgctggtccacgccgatcatggtgtagaccgacaggatcagggtcgccgaggcaatcgccccataacgttcgcccagggcgcctagcatggtcaggccaaagctggccagcgccagggcgatgacgaagatccagggataggggaacaacagttcgacggaaagggcggcgacgctgaaacacaccagggtcacggccagggcattgatccggccttgccagctgtcgtcggtctcggccagggcgctggcgataatccccaggaacaaggggatcagcaaggccatttcgtcctggtaccagcacagcgccatgctcccggtcagagcgatgaacacccgcacgctgtagctgaatttatccagcgcccaaaggcgccgcagtgactgacgaaagctggtcgatgacatgaagtgagaaagccttccggggcgatgccgctaaattgagccagtattgacgaccgcgcaatggggtcgtcacatccgacggcaaattctgttcccgcccggagctggagtgttcatccggcgtgttgccggacgctcgctgtagccgctgccgaaggctgcgataggtccgcaggacctcagggggagacgccagatcgtagcgccccttcgggtcgatcgcagcctgcggcagcggctacaggaaatggggaaaccttgtagccgctgccgagccccgcgaggctgcgatcgggcgcgcagcggccgcataacaggcgaccgtgttcggcctgtcccaccgcagtggccggttctacggctcctggggcagcggctacaggtgtcaggggaatgccgggaagcggatcagacgtactgcgcggccgcgtagccggaggcccaggcccactggaagttgaagccgcccaggtggccggtgacgtccagcacctcgccgatgaaatacagccccgggctcttcagcgactccatggtcttggacgacacctcgcgagtgtcgacgccgcccagggtcacttcggcggtgcgataaccctcggtgccggccgggaccactttccagcacgccagttgctcggcgatctgcgccagttcggcgtgggtgtactgcttcatcggtttggagacgaaccagttgtccgccagcaggccggccatcttcttggtgaagatctcgccgagcagggtcttcagctcgctgttcgggcgttcggcctgttgctgttgcagccagcttgcggcgtcgtggtctggcagcagattgatctccaccgtgtcgccggactcccagaacgaggaaatctgcaggatcgccggaccgctcaggccacggtgggtgaacaggatgttctcgcggaaactcatatcgttgcagctcaccaggcagtccaccgaggtgccggacagctcaccgcacagctccttgagctggtcggtgatggtgaatggcaccaggcccgcgcgggttggcagcagctcgtggccgaactgcctggccacctgatagccgaagccggtggcgcccagggtcggaatcgacaggccgccggtggcgatcaccagggattcgcactggagctggccgagggtggtttccagcaggtagccgctgtcgagcttctcgatctgctggatcgaggtgtccaggtgcagctgcacaccgacctggtcgcactcgtcgagcagcatgccgaggatgtcgctggacttgttgtcgcagaacagctggccgagctttttctcgtggtacggcacgccgtgcttggccaccaggccgatgaaatcccactgggtgtagcgggccagggccgacttgcagaagtgcgggttgtgcgagaggaaattgcccggctcggtgtacatattggtgaagttgcagcgcccaccgccggacatgaggatcttcttgccggccttgttggcgtggtccagcagcagcacctggcggccacggccggccgcggtcagcgcacacatcaaccctgcggcgccagcgccaatgatcacgacttcggtagagcgcaaaacagtgtcctcaataggggcaaacaaccctgtagccgctgccgcaggctgcgataaggccgaaggccttcagcgatctcaagatcccgcgccccttcgtacggagtgccgcccagatcgatcgcagcctacggcagcggctacaggtcaagcggtggtattacaggatgcgcacgcgcagcgaacggcccttgatcttgccgctgttcaggcgttgcaaggcctgcttggcaataccgcggtccacggcgacataggcctggaagtcgaagatcgcgatcttgccgacctgggtgccggggatgccggcttcaccggtcagggcgccgaggatgtcgcccggacgcactttgtccttgcgcccggcgccgatgcacagggtgctcatggccggcagcagcgggccgccgccctgggatttcaggctgtcgatctgttcccagttcaagggcgacttctgcagttgctcgatggcctgggcgcggtgcgcctcggacggcgccaccaggctgaccgccaggcctttctcgccggcgcgtccggtgcggccgacgcggtggatgtggatctccgaatcccgcgccagttcgacgttgatcaccatgtccagggcatcgatgtccaggccgcgggcggccacgtcggtggccaccagcaccgaggtgctgcggttggcgaacatcgccaatacctggtcgcggtcgcgctgttccaggtcgccgtgcaggcccaccgcggacatgcccttggcggtcaggtggtcaacggtttcctggacctgctgcttggtgaagcagaaggccacgcaggattgtggacggaagtggttcagcaccttgaccaccgcgtcgatgcgctcttccggcgagatctcgtagaaacgctgctcgatctggctgtcggcgtgcagggcttcggccttcacctgctgcgggtcgcgcatgaacttcgaggccagctgcttgatgcccaccgggtaggtggcggagaacagcagggtctgccggcgctcgggggtgtaggcgatgatctcttcgatcgggtcgtagaagcccatgtccagcatgcggtcggcttcgtcgaggaccagggtgttgaggccgtcgagtttcagcgagcccttgcgcaggtgctgggacaggcggcccggggtgccgacgatgatgtgcgcgccgtgttccagcgaggcgatctgcgggccgaaggacacgccgccgcacagggtcaggaccttgatgttgtcttcggagcgggccaggcggcggatttccttggccacctggtcggccagctcgcgggtcgggcagatcaccagggcctggcaaccgaaatagcgcggattgatcgggttcagcaggccgatgccgaacgcggcggtcttgccgctgccggtcttggcctgggcgatcaagtccatccccttgaggatcaccggcaagctttgcgcctggaccggcgtcatctgggcataaccgagtgagtcgaggttagccagcatggcggcggacagcggcaaagtattaaaagcggtggcaatggtggtcacgggacgggcctgcaaaacaaaatgtcgcgcagtgtatcagtcccgctccctttacctgcaatttctggacgagcgagccaccgttcgttcctgttgccgctgccgaaggctgcgatcggcggcgcagccgacgtcaatcgaggctgcatgtttatccgatgcggctcagtgctcgatatgctcctggaccttcttcgcccgccggccgtccctgggcgacagttgcaggaagatcgccgccgccagcatcgccatgatccccaccgtgaggaaggtcagctggaaggcgccgagcacggtgctcacgccgtcgttgccgacttcggcggtgaagccgccgagcagcgcgccggcgcaggccacccccaggctcagggacagttgcgccaccaccgacagcaggctgttgccgctgctggcggaagcgtcgtcgaggtcgatcagggtcacggtgttcatcgccgtgaactgcagcgagttgatcgcccccagcaccgccagcatgcccagcagcagcgggtagggcgtctgctgcgtgaccaggcccatgctggcgagcatgatccccagcgccagggtgttgccggtgaggacgatgcgatagcccaggcgttcgatcagcgggcgggcgatggacttggcgagcatcgccgcggcggccagcggcagcatgctcatcccggcctgggacggtgaataaccgagggccacttgcagcagcagcggcaccaggaacggcaaggcgccgctgccgaggcgggcgaacaggttgccgaggatgcccacggcgaaggtccgcaccttgaacagcgaaggcgcgaacagcgggttgtcgatatgcccggcccgcagccagtaggccgcgaggcaggccaggccgccgaacagcagcaacatcacccgcaggtgcggcaggtgcagttcgcccaggccctccatggcgatggtgatcagcaccatcgccgcgccgaacagcaaaaagcccaggccatcgaaacgcgtgcgttcgctgccgcgcaggtcgggaatgaagcgccagacggcataacaaccgatcacgcccaccggcaggttgatcaggaagatccagtgccaggtcaggtactgcaccatccagccgcccatggtcgggccgatcagcgggccgagcagcccgggaatggtgatgaaacccatgatccgcaccagttccgagcgcgggtaggcgcgcagcaccaccagccggccgacgggcagcatcagggcgccgcccaggccctggatcacccgggcgccgaccagcatgctcagggagttggacagggcacagagcaacgagccgatgctgaacagcaagatggcgccgaagaagatcttcttggtgccgaaacggtcggcgatccagccggaagccgggatcagcagcgccacggtgagcatgtaggcgatgaccacgccctgcatgcgcaacggatcttccgccaggtcgcgggccatggccggcagggcggtattgaggatggtcccgtcgagggattgcatgaaaaaggcgatggccaccacccagggcagccagcgggcggtggtggcgtcaagttcggcacggttgggcatgggacctctttcttgtggtgagcacgtatccccctgcaaccgcatcgcgggcaaacctcgcgcctacagacgccatcccgtaggagcgagatttgcccgcgacagcggttacaaggtcaacgtcagccggctcaccagcgcgcccggcaattgcgccgaggcggtctggcgctggctgtaggtactggccgacagcagcagctcgcgctcccgggtcaggccttcgaggtgcgaacccagcaggctgtagacgctgtcatcgaaacgcatggtgctgaccggagcctggatctcgccgttctccacccagaaggtggcgaagcgggtcatgccggtcaggcgcgccgccggctggtccgagtagttcaggtaccacaggttgctgatgtacaggccggtgcccagttgcttgagaatctcctgctgcgacaactgcccgggcgccatgttcaacgcgctggggtattcgccgctgccggcaccgttggtggccaggcggtattcggcggcgctgcgcgagttgatcagttgcccttgggcgacgccgccggcgatcagcgacaggtcgctgcgcgggtagccctcatcggaaaacgctgggctcaacgagccactgacctgctcgtccagcgacaccagggggctcaggctggcatcgccggcatagagcttttgcagcgggctgtgcttgctggcgatggactgcgcggaaaacccgccccagctcagcatgcccatgatttcttccagggccgccggcgccaggtaggcgcgatagtgcccgggcgccagggtgcgcagcggtcgtccgagaaacgccaactgttcccgggcctgctggaagcgctgggcgaagccctggctgctccattcgtgcccggcgtagctggctttgacggcctggccattctcatggaacaggctgaagtcgaagttgaagctgttggcctggtgccagccaaaggctcctgaggagctggcaaaaccccggctgatcgggccggccgcatagaaccccaccaggtccagcccggcggcggcctggccgatttcggccactacctgctcgctgctgggcagcgggtgctcctgcacattgtgggtgttccaggcatcggggttgagcagcaggtacgggtcccggggtagcagcggcagggtctcgcgcaactgttgcaggccttcggccaggcgctggacatcgacctgcgggtcgccggcgagggtgatgctgaggtcggcatggcgcccgtcgttgatcagcttgaagccgaggctggcctgctgcacttgcccggcctggcgcaccttggcgtggttgaaacggatgaactgcgaagactcggcggcgtagctcagggtgaactgttcgggcccgcgcacggcatcgcgcagccagtccaccagagccttgaactgctcggcctgattcagggacgtactcatcaggcatctcctccaaatacatcgacatggctgaacacacaggccggcgaggcatggccgacgcggatcacctggttcggttcgcccttgccgcagttcggcgtgcccaggacctggaaggtgctggcgtcgccgacggcgctgaggtttttccagaaatgcgcggaaatcgcccggtagttggggtttttcaccacgcccttgagttcgccgttctcgatcaactggccccattcacagccgaactggaacttgttgcgcgcatcgtcgatggaccaggaacggttggtggacatcaggatgccgttctcgataccgccgatcagcttctccagcggctggtcgccgggttcgatattgaggttggccatgcggtcgatgggcgggcggttccagctgcaggcgcggctgttggccacgccgtcgaggccggcgcgaaattgcgagagcgcgccgcccagcgggcgcagcagcaggccttgcctgatcaggaactgcttgctggcgggcgtaccgtcgtcgtcatggccgtagctggccaactgctcgggaatgtccgggtcgaaggtcacgttgagcaggctggagccatattgcaggctgccgaagtcgctgcttttcacgaagctggtgccggcgtagttgcgctcgtcgccgaggatacggtccagctccagcgggtggccgatggattcgtggatctgcagcatcatctggtccggcatcagcaacaggtcgcgcgggccctggggcgtattgggcgccagcagcaattgcagcgcctggtcggcgacctgggccccggcgccgatcagcccgcagcggctgatcacgtcggcgccgccctgctggccgaagttctcacggcccaggctgcgggtctggctgtcgctgccgtcgtaggcggtgacgtccatgcccgggtagacgaagcgctgggcctggcgcagttcggcgccggcgctgttgaggtagatctgctcgacctgagtgaggccgaggctgacctgccagttcaccaggcgctcgtccttgggcacggccgcggattcgtcgccgagcaactggtagcagtcgctcagggagggaaagggttggtcgaggttgggcgagaagtagtcgccgcggtcgctggacaccgcctgttcgcgcaggtcgagcagggcgtgggcggcgatcagccgggcttgttgctcggcgcgttgcagcgcggcctgcaggccgctttgcgacaggtcgttggtggcggcgtaagcctcgacgccattgacccgcacggtgagcatcgcgccttcgtcgcggctcaggctcggcggctccgcgacgtttttgcgcaccgacaggtactggccggattcgcgcacgtagcgcagggaaaagaattcggcgcccgtgcgcaaggcagcgaagcgctgcttgagctgggggtggaaatcgaacatctgaggaacctccatgtgaacagtctggctgttgcaggccttatcgagagcaagcgggcgtcgggccagggtttttctgtaggagcagccggtcgacgctcgattgctcgcgataaagcccgaagggctttgaagccaggtcggaaaaggtgctggggaatgctgcgagcgcctagattaggcccgtgcggtgcgcggtatcaagcagggaggggcagggaaatgttggagaactgtagttgtggccaagggctgtgattcggcaatcgggttctgcctggtgaatcgtggtggctggtttacgtcggctgcgccgccgatcgtccgaacgcggcccgaacctgcggcagcggctacaggacggatacagtaaaacggcgccgatcgttgcgatcggcgccgttcgaagttactgcgcggtagcgctcacttcacgtaccggcttgccacgtaccggggcatcgcccgccacgtagtaggcggccttgctgcgcggtagtggctggcggccacggatcttgtcggcgattttctcggccatcatgatcgtcggcgcgttcaggttgccggtggtgatgatcggcatgatcgaggcatcgaccacgcgcagaccctgcatgccatgcacgcgaccctggccatcgaccacggccatttcgtcggtgcccatcttgcacgagcaggatgggtggaacgcggtttcggcgtgctcgcggatgaatttatccagttgctcgtcggtctgcacttcgatgcccgggctgatttcgcggccgcggaaggcgtccagcgccggctgttgcatgatttcccgggtcaggcggatgccgtcgcggaattcctgccagtcctgctcggtggccatgtagttgaagaggatgctcgggtagtcgcgcgggttcttcgacttgagctggatccggccgcggcttggcgagcgcatggaacccatgtgcgcctggaagccgtgttctttcacaccgttgctgccgttgtagttaatcgccaccggcaggaagtggtactggatgttcggccattcgaactcttcgcgagtgcggatgaagccgccggcttcgaactggttgctggcgccgataccggtgccgttgaacagccactcggcaccgatggctggctggttgtaccagagcagcgatgggtacagcgagaccggctgggtgcaggcgtactgcaggtacagttccaggtggtcttgcaggttttcaccaacgcccggcaggtcgtggaccaccgggatgtccaggctttccaggagcttggccgggccgacgccggaacgttgcaggatctgtggcgaggcgatggcgccggagcacagcagcacttccttgcgggcacgggcttcgacgcgctcttcggcggaaccgaccaggtaacgcacgccaacggcacgcttgccttcgaacaggatcttgtcggtcagggcgtgggtgacgatgctcagggtcgaacgctttttcgccacgtcgaggtagccgcgggcggtactggcgcgacggcctttaggcgtcacggtacggtccatcggaccgaaaccttcctgctggtagccgttgaggtcttcggtgcgcgggtaaccggcctgcacgccggcttcgaccatggcgtggaacagcgggttgttgccggctttcggcgtggtcacgctgaccgggccgtcgccaccgtggtagtcgttcgggccgatgtcgcgggtttcggctttacggaagtacggcaggcagtccaggtaggtccagtcttccaggcctggcagttttgcccagccatcgtagtccatggcgttgccgcggatgtagcacatgccgttgatcagcgaggaaccgcccaggcccttgccgcggccgcattccatccggcgaccgttcatgtgtggctccgggtcggtttcgtaggcccagttgtagcgacggccttgcagtgggaacgccagggcggccggcatctgcgtgcggaagtcgaaacggtagtccgggccgccggcttcgagcagcagcacggtgacgccttcgtcttcagtcagacgggtcgccagggtgttaccggcggagccggcaccgatgatgatgtaatcgtattcttgggacattgaatgcaccctctttgagatggggtcagatcggacgatcaataaacctgtagcggctaccgaaggctgcgatcggcccggaacgggacgcgctcttgaggctctcgaaggccctacgggccttgtcgcagcctcgcaagttcggcagcggctacagggtttgtcgttcaggctgggtgtcttagaacaccgaggcgtagtcgcccagctcgacctgtaccgatttgatgcgggtgaagttgttcagcgagctgatgccgttctcacggccaacacccgactgcttgtagccgccgaccggcatcttggcgtcggattcgccccaggcgttgatccagcagataccggcttcgagctgatgaatcacgcggtgcgcgcggttcaggtcacgggttaccacaccggcggccaggccgaagtcggtgtcgttggcgcgacggatcacttcttcttcggtttcgtaggtcaggatgctcatcaccgggccgaagatttcttcgcgaacgatggtcatctcgtcggtgcagtcggtgaacacggtcggcgccacgaaagcacctttggcgaatgcgccgtcggtcaggcgttcgccgccgcacagcaggcgagcaccttcttccttgcccttggcgatgtagcccagcacgctttccatgtgggcgaagctgaccagcgggccgaagttggtgttttcgtcttccgggttgccaacgcgaatgcgcgcgacgcgctcgacgatcttggcttcgaaagcggctttcaggtggctcggtacgaagacgcgggtaccgttggtgcagacctgaccggagctgtagaagttggccatcatcgcggtgtcggcggcgcgatccaggtcggcgtcgtcgaagatgatcagcggcgacttgccgcccagttccatggtcacgtctttcagcgaggagctggaagcgctggccatgaccttcttgccggtgtcggtgccgccggtgaaggagactttctcgatgcgcgggtgttcggtcagccaggtgccgacttcgcggccgctaccggtcaggacgttgaacacgccagccggaacgccggcttcggtgtagatctcggcgagtttcagggtggtcagcgaagtgacttcgcttggcttgaagatcatcgcgttaccggccgccagggctggcgcggatttccacagggcgatctggatcgggtagttccacgcgccgataccggccacgacgcccagtggctcgcgacgggtgtagacgaacgaagtggtgcgcagcgggatctgctcgccttcgatggccggtaccaggcccgcgtagtattccagcacgtcggcgccggtgacgatgtcgacatacttggtttcggagtaggccttgccggtgtccagggtttccagggcagccagttcatcgttgcgctcgcgcaggatgtccacggcgcgacgcaggatgcgcgaacgctccatggcggtcatcgcggcccagatcttctggcctttctcggcgctgaccactgcgcgttccacgtcttccttggtcgcacgttgcacttgagcgaggacttcaccgttggccggattgatggcatcgaaggtggcgtcgctgccggcgtcggtgtagccgccgtcaatgtagagtttttgcagttcgaaacgggccatgttgatagtcctcgcaagtgcataagtggttggcgttcaccactgggcgtgccgtgtagcctgggcgcgctggtcagtggcagttcagggggccgagcgtcttgtaatgtgctctagcgctcctgcttagccagttggaaatccatgtattcgtaagcgatccggtgcgcctgctcggtgtcgaaagagtctcccgacagcgcgccgcgcaaccacaaaccgtcgatcagggctgccaggcctcgcgctgcgctgcgtgcatcatccagcggcaggacgcggcggaactggcagcacaggttggaatacaggcggtgatcgttgatccgctgcaacctgtgcaaagacgggtggtgcatgctggtggcccagaaggccagccaggttttcattgccgggccattgacctggctggcgtcgaagttgccttcgatgatcacctggaggtgcgcccgcgggctgctgtcctccagcgcctgacggcgcgcggtgacgttctcgctgaggacactcatcagatactgcgccgtggcggcgatcaggccgttcttgtcctgaaagtagtgactgatgatgccgttcgagacaccggccaaacgggcgatcagcgcaatgctggcgtcccccatcccgacctgatcgaccgccagcaacgtggcttcgatcaactgctggcggcgtatgggttgcataccgaccttgggcatcttgcacatctccttaggcctgctggcagtcgtgaaacggctaccggcgtgagggccagtctattttgttttgattgaacgttcaatcaacaaagaataagatctgcgacaaatcgtcgctgcctccaggtccttcctgcgtgtagatggcggaaaagcgacctccgaaaaagcctgaaacccaagcggggcatggcgtgaaccagtgaggacggatgtgttgaatgggcaagacgcttaaggccaggtgacgaactgcatgtttgcacaaggccttcgacgctggttctcaacgcaacccctgcgggttcgggcttttttcggggtgtctttatatcacccgtcggtcggctgccaactaaccgattggtcgggtgccgtgttgccttgtgttcttctctcgcactgcctggagcatctgtgccatgagttctgcctctcttataaagaccccaccggaaaaggtgcgggtcaacggttgggtgttctacacctctaccgcgctgatcctgttgctgaccgccattctgatcatcgccccgcaagaggccggcagactgctcggcattgcccaggcctggttgtcccgcagcttcggctggtactacatggtggtgatcgccgcctacctggtcttcgtcgtcggcctggcgttttcctcctacggcaaactcaagctggggaccaagcaagacactccggatttcagctatggcgcctgggccggcatgctgttttcgtccggtatcggcatttcgctgctgtacttcggcgcttccgaaccgctggaccactacttcaatccgcctgaaggcgtaccgggcagcaaccaggctgcgcgttcggcgctgcagctgacgttcctgcactggggcctgcacggctgggcgatctatgccctggtcggcctggccgtggcctactttgcctaccgccacaaccagccgctggcgctgcgttcggcgttgtacccgctggtgggcgagcgctgggtcaagggcgcggccggccacgcggtggacggtttcggcatgttcgtgaccctgctgggcctggtgaccaacctgggcatcggctcgatgcaggtgtcttccggcctggaaaacctgttcggcatggaacacagcaacaccaacctgctgatcgtgatcatcgtcatgagcaccgtggccaccatcgccgcggtatccggtgtggaaaacggcattcgccgcctgtccaacctgaacatcgtgctgttcagcggcctgctgatcttcgtgctgctgtttggtccgaccctgcacctgctcaacggtttcgtgcaaaacgtcggcgattacctcaacggtgtggtgctcaagaccttcgacctctatgtgtacgaaggcgacagcaccaagtccgaccgctggctgggcctgtggaccctgttctactgggcctggtggatttcctgggcgccattcgtgggcatgttcatcgcgcgtatttcccgtggccgtaccgtgcgcgagctggtggcgggcgtgctgctgattccgctgggcttcaccctggcctggctgtcggtgttcggtaactcggccctggacctggtgatgaaccacggcgcggtggaactcggcaagacggcgctggaacagccgtccatggcgatctaccagctgctggatcattacccggcgtcgaagattgtcatcggcgtgtcgattttcgtcggcttcgtgctgttcctgactccggccgactccggcgcggtgatgatggccaacctgtcctgcaagggcggcaacgtcgatgaagatgccccgcactggctgcggatcttctggtcggtggtgatcaccctggtgaccgtcggtctgttgttcgccggtaacttcgaagccatgcagaccatggtggtgctggccggcctgccgttctcggtggtgctggtgtgcttcatgttcggcctgcacaaggccatgcgccaggacacgcagatcgaacaggagcaggcggaactggcggcccgtggccgtcgtggtttcagcgagcgcctgacccagcttgacctgcagccgacccaggcggtggtccagcgtttcatggacaagcacgtgacgccggcgctggaagaagccgcgacccagctgcgcaaccagggcctggatgtgcaaaccctgctgggcaagtccaagcgttgcatgggcgtgcggatcgagatggaagagggcaacccgtttgtctatgaagtgagcctggacggctacctggcggcgccgagcgaatcggccgatgcgcccgaagagcgtgcgcgctactaccgcgccgaggtctacctgcacaacggcagccaggaatacgacttgatgggcttcactcaggagcagatcacccgtgatgtgctcgatcagttcgaaagccatcggcagctccttggccgggtctacagctaagacgtgagagacgcggtgtagccctgttacaccgcgttgtctgtatcgcgagcaagctcgctcctacaaggattgcatttgacctggaggagcgagcttgctcgcgaagcgccatccctgacccagcgcaacaccggctcccgcaacagggagcaaacctgcactctttattcccgataaaacaaaaacgccgcgatcgatgtcgcggcgtttttgtttgcgtgtcgctgttaccccaggttcttgccgagcagcgcgtggtagagctcgctgtcgccgaggatccccaccaccttgttgttgtcgtgcagcaccagcttgttgccggtctggtagcggatctgcagcgcgtcgcgcatgccgatattggagtcgaccagggtcggcttgcggcccaggccttccaccgcctggcccgggatccagttctgcaggtcgaggctggcgccgttctggcgtgcgcccttgatggtgttgccctcggccaggtcgagccaggagtcgccacccgggtccaggcacaccgagccgttgatgcgtttgcagttgtccagggtgcgcatcaggctgcggccgcagagcacgttgagcgggttggtatgggcgacgaaggtgcgcacatagtcgtccgccgggttcagcacgatttcttccggcttgctgtactggatgatccggccgtctttcatgatggcgatgcggctgcccagcttcagggcctcgtcgaggtcatggctgacgaacacgatggtcttgctcagcttgcgttgcagctccagcagttcgtcctgcaggccctggcggatcagcgggtcgagggcggagaagggttcgtccatcagcaggatgtcggcgtccatcgccagggcgcgggccaggccgacacgctgctgcatgccgccggacagctcgtcgggcttcttgttgcgccactgggtcaggcccaccagctcgagtttctcgtccaccagcttgcgccgttccttttccggccgaccctgcatttccaggccgaagctgatgttctcgcgaacggtcagccagggcatcagggcgaacttctggaacaccatggcgatgcgcttggtgcgcatcatcttcagttccgccggggtacaggaagcgatgtcgatctgcttgccgtcatgctcgacgaacagcttgccgcggctgacggtgttgaggccgttgatgcagcgcagcaggctcgacttgccggaaccggagaggcccatcagcacgcagatttcgcctttctcgatgtccaggctggccttttccacaccgacgatctggccggtctttttcaggatctcgttgcgggtcatgccctgatccagcagcttgagcgcctcgcgtggatccttggagaagataacgtcgacgttatcgaagcggattatgctcatgcgtcaccccctactttggcttcgggttgtttgcagatacggtcgagcatgatcgccagcagtacgattgccaggcctgcttcgaagcccagggcgatatcggcggtgttcagtgcgttgaccacgggtttgcccaggccatcggcgcccaccagggccgcgatcaccaccatcgacaacgacagcatgatgcactgggtgatgccggcggcgatgctcggcatggcatggggcagctcgatacgcgacaacagttgacggcgggagcagccaaaggccttgccggcgtccatcaactcttgtggtacatcgcggatgcccaggtaggtcaggcggatcggcgcggcaatggcgaacaccaccgtggaaatcaggcctggtaccacgcccagaccgaacagggtcagggtaggaatgaggtaaacgaaggtcggcacggtctgcatcagatcgagcaccggacgcatcatggtgtagaacatcggcttgtgcgcggcgacgatgcccaacggcacgccaataagcacgcagaccagggtggcgaacagcacctgggccagggtttccatggtttcctgccagtaacccagattgagaatcagcaggaaggacagcacgacgaaggccgtcaggccccatttgcgttgaatgatgtgcgccagcaaggcaatcaggccgatcaaggccagtgggttgaaccaggtcagcgcaaacgtcacgccgtggatcatcgtttccagggtcgatgcgatcgcatcgaatgtgttggcgccatgttgcgtcaaccattcgacgaaggcagcgatgtactggcctaaagggattttctgatcaatgagcatggtattgaacgtccgcatgcaaggaataaacagcccgggcgggcgaccccacccggcataagcgacttactgtgcaagcttggctttcacggcctccaggccaggttttccgtcaatggtggtcacgccagcgagccaggtatcgagtacctcggggtttttcttcagccaggccttggcggccgcctcgggcttcatcttgtcgtccaggacgttacccatcagggtgctttccatgttcagggtgaacgacagattcttcagcaactgaccaacgttgctgcattcctcggcgtagcccttgcgggtgttggtgtagatagtcgcctggccgtagttggggccgaagaactcgtcgccaccggtcaggtacttcatcttgaaacgggtgttcatcgggtgcggttcccagcccaggaacaccaccgcggtgctgcgccgttgcgcgcgctcgacctgggacagcatgcccgcctcgctggactcgaccaccttgaagccggcgtccttgaggccgaaggcgttcttgtcgatcatgctctggatcatgcggttgccgtcgttacccggctcgatgccgtagatcttgccgtccagttctttcttgaacttggcgatgtcggcgaaatccttcaggcccttgttgtacagctcttccgggaccgccagggtgtacttggcgttctccaggttggcgcggatggtttccacggtgccggcatcgcggtagggcttgatgtcgttttccatggtcggcatccagttgccgaggaacacatccatgttcttgccatcggccagggacttgtaggtcaccggcacggaaatcatcgtggtcttggtcttgtagccaagggcatcgagaacgacgctggtggtcgcggtggtgacggtgatgtcggtccagccgacatcggagaagtttacggtgctgcattgcgccggttctgcggcgtgcgccagaagcggcagactcagcatggcggccaacaacaacgacggggaacctttcatgggtggactcctgggtgttttctggcggtgtatctgaccgcacttataagtgttgcggttggggcgagtgggacagctctaccacagtgccttgcaatcgagtcgagactgatcatgtaccagtgaaaatctgacgcctacagggtgcgtcgtatccagtacagggagggtcgcatccagtgtcggtgaggtcgcttacagcttttttcagcactttttgcccatctgaaccgcaaaaaaacggccagaaccagaggtcggcgggccacggcgttggtgggcatgagtgagtcggtgtgagacgtcgaacgacactgcaaaagcctgatgatgcgcgtatctcggcggattactgcttgagcgtagcagcttcgccaccgggcgttttggcgcccggcgtgtgctcatcgaggagtttcgcagtcatggctatcagtgttttcgatctgttcaaaatcggcatcggcccctccagttctcacaccgtcgggcccatgcgtgccgcggcgctgttcgtccaggccctgcgcgagaaagacctgctggagcaggtgcgccgcatcgaggtaaggctctatggttcgctgtcggccaccggcatcggccacggcagcgacaacgcggtgatcatggggctgatgggcgaatggccggatgcgatcgatccgtcgcagatcggctgtcgtatcgagaccctgcgcgaaaccaataccctgctgctcgacaaccgcctgccgattcccttcgtctgggcgcgcgacatgctgctgatcgacgagaacctgccgttccatcccaacgccatgaccctggtggccgaaggcgagtccggggagctgcaccgcgatacctattattccgtgggcggcggttttgtcgtcgaccaggcccaggccagcagcggcgtggtggacctggatcgcaccgaattgccttatgacttctccagcgccgtggagctgctgagcctgtgccagaagcacaacctgcgggtggccgaactgatgatggccaacgagaaggtctggcgttcggaggaggagatccgcgccggcctgatgaagctctggcaggccatgcaggattgcgtcgagcagggcctgaaacacgaaggcatcctgcccggcgggctcaatgtgcggcgccgcgcggccaagctgcaccgcagcctgcaggaactgaacaaacccaatgtgatcggctcgaccctgagcgccatggagtgggtcaacctgttcgccctggcggtgaatgaggaaaacgccgccggcggacgcatggtgacggcgccgaccaacggcgcggcggggatcatcccggcggtgctgcattacttcatgcgcttcagcgaggacgtcaccgacgccaacgtggtggactttttcctcggcgcggcggcggtgggcatcctctgcaagaaaaacgcctcgatctccggcgccgaagtcggctgtcagggcgaggtgggctcggcctgcgccatggccgccgctggtctggcggagattctcggggcatcgccggagcaactgtgcaacgccgcggaaatcggcctggagcataaccttggcctgacctgcgatccggtcggcggcctggtacaggtgccatgcatcgagcgcaacgcgattgccgcggtgaaggccatcaacgccgcgcaaatggccctgcgcggcgacggccagcacttcatttccctggaccgggtgatccgcaccatgcgcgataccggcgccgacatgcatgacaaatacaaggagacatcccgcggcggcttggcggtcagcgccgtggagtgttgatgctttaacagcgggactgctgcgcagttcatcgcgggcaagcctcgctcctacaaggtgctgtgttctcctgtaggggcgagcttgctcgcgctgacgtcaggctttttaccgccaaccacaagtagaattcatccgtcaggtcagccgggttctgctcataaattgaacacctcgcgacgccctcgccaccttttggagcgtcgcaaacaggtaagtcccaaggcccatcggtcaggtttttcgctgacctcggctgagcgcccacctgtgcttgcggtgacactcttttcccgggacgtttctcgccgttcccacaagtgctaccgatttgctcacagccaccggcccagggccctccacggccgattcggcactgataacccgcacattgcgcacggcttatatagacgcatcgcgacgtcgttttcaggagttattgaatggccattcaattttaggcatggcaattgctctgtcatcacaaagcccgtctcccgcgtgagaatgatggcaataacaagagcctccgcctgaggccatcacctgctttgtgtgaggagataccgcgatgacgacgttcaactccggggctcaaccccagaaccgtgcgcctcaatccatcggctttttgctgctggacaatttcacgctgatttccctggcgtccgcggtcgagccgctgcgcatggccaaccagttgtccggccgcgagctgtatcgctggaccaccctcagcgtcgacggcggccaggtctgggccagtgatggcctgcagatcacccccgacgcctccatgcacaaagccccggccctggacaccgtgatcgtctgcggcggcatcggcatccagcgcaccgtgacccgcgaacatgtgtcctggctgcaaagccaggcgcgccagtcccgtcgcctcggcgcggtctgcaccggcagctgggccctggcctgcgccggcctgctcgacggcttcgattgcagcgtgcactgggaatgcctggcctcgatgcaggaagccttcccgcgggtggccatgagcacccgcctgttcaccctcgaccgcaaccgcttcaccagttcgggcggcaccgcgccgctggacatgatgctgcacctgatcagccgcgatcacggccgtgaactgtcggcggcgatctcggaaatgttcgtctacgaacgtatccgcaacgagcaggatcaccagcgcgtgccgctcaagcacatgctcggcaccaaccagccgaaactgcaggaaatcgtcgcgctgatggaagccaacctggaagagccgatcgacctcgacgaactggcggtctacgtttcggtatcccgtcgccagctggagcggctgttccagaaatacctgcactgctcgccatcgcgctactacctgaagctgcggctgatccgcgcccgccagctgctcaagcagacgccgatgtcgatcatcgaagtggcttcggtctgcggttttgtctccacgccgcacttctccaagtgctaccgcgagtacttcggcattccaccgcgtgacgaacgcgtgggctccaacaccgcccaacaggtggcgatgatgccgattccgcaggcgctggtgctggctggcccgatgtcctcgctgagccaggcgcgcaacgaatcgaccttcgccagcgtcaggctgtaatcacaggcttttcctgaagtacacgacgcgctcggtttcctcgaaaccgagcgctttgtgcacggtctggctcaccaggttttccaggccggtatccgaagccatttccacgcagccctgatcccgtccccattgggcgacggcatcgatcagtcgttcggcaatgccctggcgccgctgttcggcgctgacgtacaacccctccagaaacaccaccggcgaatgctcggtgccgttcacgtagtcgtggcgcaacgaagcctcggccaaccctactggctgcccatcggcggtataagcgagcaggttgatataacgccgcgggtcgtccagcaagcgggcgatttcgtcccggtgttcctcggccggacagtcgggccacagcgcctggcgcaatgacagccagcccgcttgatgggctgactggcagggttcgattcgaatcatgggggcggctccttggcttgcaggcaccgcactctactctgcgatccgcgcccggcgaaggctcaggcgcggctgttctggaattgggccagggccggcaacagttgtttgtcgatagcctggcgcacggccggcaggatggtcgcattgccggtgagcatctgctcgaccatgcccttgagggccttggcccgggcatcgctcaagccgcgcaccgcacactcgcaggcctggtcggccgtggcgccggccggcatttcaaaacccagggccctcagctggccgagcaggtcgtcctggtcaatcagatccgcgtgcatcatgactcttatccttgttcagggagcgtggtcgtgagccgattctggtagccacccggacagtcggcaagggcgaattgtcgcaatggccgggatgcctatgaacaggtcgttttcggctaacttggcttgaaggcgactgggcacactggattccagctcggtcatcgaaggtttggtcaccctcgtgtcggctcctcagaaaacctcctctgccccgatcctgtcacggcttgatcggggtctttttttgtctgggaaaaaggggctgcctgggaggttttttcgcgagcaagctcgctcctacagaggcgatgtcgtacccagcatcgtgctacgacgcgaacctgtaggagcgagcttgctcgcgattgacgcgacgcggtctagcgctgcaacaccaggatccgcgacagcaactcgtcgcggtcgatgtagcaaccctggaaatgccgcgcgccggttgcggggtcgaaggcgttgcgcgcgtgcagggtgcggcggttgtcgaagcaccacagctcgcccgggttgaggcgttggatcaggcgaaagcgcggctcgcgggtcatggcgataaaacgtcgataagcgcggtagagccggggcatgtcgtccaccgaggcctcgaacggcccgcgcaggaagttggccatgcggatctccgtgacctcgcccagcgcatccagggcgatcaccggcgccaggcagcggtagtcgctgtggcggtccttgttgcgaaactccacgggaatctcgcacagcgcgcgaaacgcctcggggtcttcgcggcgcaaggcgtcggcgatggcaaaaccgtcgacaaagatgctttcgccgccttcggcgtcgttcaccaggcaatgcaggaactgcaggcccggttgcagctcgcgggtcggcaggtcggtgtgcagcggcaggttgaaggcggtgtaggcgttgctgtcggcgtcggccttggattgcacgttgaacagcacgccgaaattgctctcgcggataaaggcaatgcgcttggcgacctgggccagcgcccccggttcggtgggcaccccacggacttgcgtcaggccgatgtcgcgcaccgccagcagccattgcagcagcgcctgcgggtcctccatcagcgcctggtactcgaacaccggcaattgcagccgactgtcccacagctggctgtgcgggcgacgcgcgcggcgctcggcgcggctttcatcgtcgtaggcgtgggcccgcagccagcccggatcgaagcggctgaggtgaccgtcctgccagtcgatgctcaggcagccctgggcgtcgatccggctggcggccggggccaggtcttcggcgacgtcgacgatctccagcacctgctcgcgggtcacgctgtacacgcagtgcgcgcaggggcagttgtcgcgcagccactgatgatgaaaggggctcgagcgaccgtcggcccactgcacctgaacacggtccgcctgggcttgtacggcggtcaacgcgctgatcaacgggtaactgcggaagtcggcaaaagcggtggaggtattcacggtgcggtcctttcttatgggcggttatttttccggcggcagggcaatcacccgaccgatccaggcgggggcggggaggtcggcctgctcggcggcgatggcctgcaggcactgcagcaccgactcgctgaacggcgccgagcgcgggccggcgaggtcgacgtggagcagcatctgctcgttgccggccagctccaggtcgtcaccgaccttgtgcaggctgtggtacaggtgcaggcgcttgcggtcgtggccgatgatctgggtgcgcacttcgacctcggtatcgagcttcacttcatgcagataattgaggtgcagctccagggtgaacagcgagttgccgctggcttcgcggtggttgctgtccatgcccagccggtccatcagggcgtcggtggcgtaactgaaaatcagcaggtagaaggcgtcccgcaggtggccgttgtaatcgacccagtcggggctgatgcgggtggtgtaggtggtgagtgcgggcatgtcatgggctcacgaaaatggtgggctgaacctgtagccgctgccgcaggctgcgatcggctccgcaggagacgcgctcttgcggccctcggaaggctctttgagccttatcgcagcctgcggcagcggctacagggggcgtcagggttactcgctgaagctcatgccgtgtttggccttggtggttttaaccgcttcgagcacggcgagcaggcagtcatcacgatagcgctccagcgccgaaatgctgtgggtgccgagctgctcggcggtgccttcgaccacgtcgtcgatcagcttgtcggtcagttccggggccggcaggtaggtccacggcagttgcagggccgggccgaactgggccatgaagtgccgcatgccggcatcgcccccggccagggtgtaggtcaggaaagtgcccatgaacgaccagcgcaggccggcgccgaagcggatcgcgtcgtcgatttcgccggtggtggcgacgccgtcgttgaccaggtgcagggcctcgcgccacagcgcttccaaaagacggtcggcgataaagcccgggacttccttgcgcacatgcagtgggcgcatacccagggattcatagaccttgatcgcggcctgcacggcttctggcgcggtgttcttgccgccgaccacttccaccagcggcagcaggtacaccgggttgaacgggtggccgaccacgcagcgttccgggtgggtcgagctctcgtagaactcgctcggcagcaggccggaggtgctggaaccgatcagcgcattgggcttggccgcggcgctgatcctggcgtgcaggtcgagtttcagttccaggcgttccggggcgctttcctggatgaagtcggcgtctttcacgcactcctcgatggtcgcgacaaaacgcaggcgatcctgcgtagcgcccggtgccaggccctgtttttccagggcgccccaggcattggccacgcgcttgcgcagggccgcctcggcgccgggcgctgggtcccaggccaccacgtccaggccgtgggcgagggcgcgcgatacccagccgctgccgatgacaccgctgcccagggcggcgaaggttttgatctcggtgataaagctcatgacaggtttcctgaaagtcaaaagtgaatgcatctgtagccgctgccgagaaacgcgaggctgcgtgcggctgcgcagcagtcgtaaggccggacggtgcggtaaatcaggtcattcgtggtcgcccttgtggcggctgcgttgcagccgtgcgcagcctcgcgggctcggcagcggctacaggcaaccgccttcggggtcagccgcgcttgcgcaggcccatcctggcccggccctcggccggggtcaggacgcgggcgccgaggcggctgaggatctcgccggcgcgctccaccaactggccgttggtcgccagtacgcccttgtccagccacaggttgtcctccaggccgacccgcacgttgccgcccaggagcaccgcctgcgcggccatcggcatctgcatgcggccgataccgaaaccggcccagaccgcgccggccggcaggttgtcgaccatggccttcatggtggtggtgtcggccggcgcgccccagggaatgcccaggcacagctggaacagcgggtcgtccagcaggccttccttgatcatctgcttggcgaaccacaggtggccggtgtcgaagatttccagctcggccttcacccccagctcctggatgcgcttggcgccagcgcgcagttgcgccggggtggacacgtaaatggtgtcgccgtcgccgaagttcagggtgccgcagtccagggtgcagatttccggcagcagttcctcgacgtgggccaggcgggtcagcgggccgaccaggtcggtgttggggccgaactccatcgggttttcgccgccgccgatctccaggtcgccgcccatcccggcggtgaggttgacgatgatgtcgacgtccgcttcgcgaatgcgctccatcacttcgcggtacagcgccacatcgcggctgaacttgccggtgtccgggttgcgcacgtggcagtggaccacggtggcgccggccttggccgcttccaccgcggcggcggcaatctgtttcggggtgaccggcacgtgggggctcttggcggtcgtgtcgccagcaccggtgagtgcgcaggtgatgatgacgtcgtggttcatggtgcgggttccttacaggcgtggtgggtcgctgcgcagccgtttggcgctgcgcagagggagttcggggtggttattggctggtcagtttcaggttgtcggccgcgggcttgccgtcgaaggtggtgaccccttcgagccagcgcgccttgtcctgcggatgctcggccagccattgcctggccgattccagggcgtccttgtggtcgagtagcggttgcatcatgcggctctcgtcctcggcgctgaaggtcaggttgctcagcagccggttcacgttcgggcactgctcggcgtaggtcggcgcggtgacggtccacacggtggccatgccttcgttcgggcccagggcgtcgtcgctgccggtgaggtaggtcatctgcacattgacgttcatcgggtgcggcgcccagccgaagaacaccacggcttccttgcgtcgcacggcgcgatccaccgccgcgagcatgccggcctcgctggattcgaccagctggaatttgcccaggccgaactggttcttggtgatcattgccttgatctgggtattggcgcccgagccgggctcgatgccgtagatcttgccgcccagttccttctcgaatctggcgatgtcggcgaaggtcttcaggcccttgtccgccaggtaggtaggcacggcgagggtcgcgcgggcgtccttgaggctgggctcggccagcaccttgacctgtttggcctcgatgaagggggtgatggtctgggtcatcagcgggttccagtagccgaggaacaggtccaggcgctggtcgcggatgccggcgaaaatgatctgctgcgaggcgctggtctgcctggtcttgtagccgaggccgtcgagcagtacctgggccatggcgctggtggcgatcacgtcggtccagttgaccacgccgaggcgcacgttctggcagctggcggcgtcggcggccatggcgccggagctgagaaagacggtaccgctgagtgcaaggacgcaactgctgatcagtcgtttcatgaaggtttcctcggcaggtcgttattgtcggttccggcgtctatgtgcgtcggtgatgccacgttacgcagccggcgggcgctgaaaacgcacagcggcgaccggctcttgcactgcggcgaccttggtcttgaacccggcgtggaaacggcgtatcacagtggccacgctgcccgtcatccgagtgcgttccatgtcccaggatttctatttcttgctgatgccgggtttctcggccatcgggttcatctcggccatcgagccgctgcgcgtggccaatcgctttcgcggcgagctgtatcgctggcatgtgctgagcgccgatggtggcgcggtattggcgagcaacggtatgtcggtcaacgccgacgcggcgctggagccgttgaagaagggcgcgaccctgctggtggtggccggcttcgagccgctgaagttcgtcaccccggcgctggtgcactggttgcgccgcctggatgtggagggcgtgaccctgggcggcatcgataccggtagcgtggtcctggcgcaagccgggctgctcgaaggccaccgcgtgaccctgcactgggaagcgatcgaggcgttcaaggagtcctatccgcagatcagcgtgacccaggagctgttcgagatcgaccgacggcgcatcacctcggccggcggcaccgcgtccatcgacatgatgctcgacctgatcggccaggcccacggcccggagctggcgatccaggtcagcgaacagttcgtgctcgggcgcatccgcccgcgcaaggaccaccagcgcatggaagtcgccacccgctacggcatccgcaacaagaagctggtgcaggtgatcggcgagatggaacagcacagcgagccgcccctgagcaccctgcagctggccgaatcgatcaaggtcacccggcgtcagctcgaacgcctgttccgcctgcacctgaacgacaccccgagcaacttctacctggggctgcgcctggaaaaggcccggcaactgctgcgccagaccgacatgagcgtgctggaagtcagcatcgcctgcggcttcgaatcaccctcgtatttcacccgcagctatcgtgcgcggtttgcccagtgcccgcgggaagaccggcgccaaagcctgaaggcctgagctgcccgattctgtaggagcgaagcttgctcgcgatgcaggcaactcgcagcgtcagacaaaccgccatcgcgggcaagcctcgctccagagccagggtttatttcttcagcagggccgcgcaggcggttttgtaggcttcatgctgatatttgttcagcgtcgccggcaggtcgaagttgtgcttcttgttctgcgcgttgatggtttgcggcgacagcagggtcacctcgcagttgtccagcagttggaacacaccttcgatcttgaaggtggtcgggccgccggcgaattcgccttttttgctgcgtttcttgatggcgatgcggctgatgccgttgtcgcggacgaaggcggccacctgggccgcgaaggctttgacgttggcggcttcgtcatcgtcgtccagggcgattttcttgcaggcgttggccaggtgttgcgccgtgccgtcttgcagggtggccagggcgaagatggcttcgctgcctttgatttcgatgccgcagatgctcatgggaaaaccttttctcgatgaatggcgtgcagcttacagttccagctggtcggcgcgaatgccgaaggccgcggcgatcttctcgcgggtggcgcggcggggcttggcgacgctttcctgctgggcgaaggccggctgggaaatgcccaggcgcttggcgacctcgtcctgggtcaggtgcaggtgctcgcgccaggcgcggatcggcgtggcgccgtcaacgatgcggctgaccacgtcatgggggatcaggtccggctcctggcgttgcgccacatagtccgcataagggatcaccacgaacgccggcttgccgtccgtgccgttgatgatctggatgtcagtaggtgcgttcgtcacgtttcttgacctcttggatactgaccactctgatagcgccatcccagtcgaacaggattcgatagttgcccactcgcaggcggtaagcatgggtgtgaccgctgagtgccttgatgttgccggtgtcgggcatgtcgccgagcaaggtcaccgcgtcgcggatctgtacctgatgggcgctgtgcaatcgcagcagttgtttgacggccttacgggtccacaggatgctgttcatgaacaaatataagccttttataagattaatcaatctttgcttatatttgctcgcgggccaaggcgagaaccttgtccgggtattgctcatggcttgttacagcggggagagaggggaggccgggggattttcgcgagccagctcgctctacaggtatggcgcaacgcctgtaggagcgagctggctcgcgatgacgtcatgacggttgccgcagaggtatcggtcgggcctattcctgcccgatcgactccagaaactccgaccgttcatcgctcatgcgcgccaggcaatcggcctgggcgatggcgtaggccttgctgccgggtttggcggggaaagtgtcgacggcgcagtcggcgtcgcgctgtttctgccacagctgctgggcgttctgcaccttggcggtgatgtcggccagctgcgccttgtcgctgccgtattgcgtgcccaggcgttcgagcaggccctgcaggttgtcgttcagcagttgctcggcggtggttttgttgaaggtggcgcattccagagtctgttgatcctgttcgacgctgtcgcacggggagttgtcggcctcttcagccgcctgtgcgcccgtcgccagcagtgccaaagccaggaagatcgatttcattgcgtcgcagccccctctaatccagtgatgcggcggattctggcccatgcgcatgacaaagaacagatggtgcaagggacgcccggcagaccctttgtcgcggattgacgctttcggcaattcccctgtcgtttttgcacccggctgcccgggcaccgaggcatatgctgaccccaaagcgccggcagacgattcggcgcatgaattgccaataaggggactgcctgatgagcccagccgaattgcacgccgacagcatcgttatcgacgggctgatcattgccaagtggaaccgtgaactgttcgaagacatgcgcaagggcggcctgaccgcggccaactgcaccgtgtcggtgtgggagggcttccaggccacggtcaacaacatcgcctccagccagaagctgatccgcgagaacagcgacctggtgatgccggtgcgcaccaccgccgacatccgcaaggccaaggaactgggcaagaccggcatcctgttcggcttccagaatgcccatgcctacgaggaccagatcggctacgtcgaggtgttcaagcagctgggcgtgggtatcgtgcagatgtgctacaacacccagaacctggtgggcaccggctgctacgagcgcgacggcggcctgtcgggcttcggtcgcgagatcgtcgccgagatgaaccgcgtcggcgtcatgtgcgacctgtcccacgtcggctccaagacctccgaggaagtcatcctcgaatcgaaaaagccggtctgctactcccactgcctgccgtctggcctcaaggaacacccgcgcaacaagtccgatgaagagctgaagttcatcgccgaccacggcggtttcgtcggcgtgaccatgttcgcgccgttcctggccaagggcatcgattcgaccatcgacgattacgccgaggccatcgaatacaccatgaacatcgtcggcgaagacgccatcggcatcggcaccgacttcacccagggccatggccaggacttcttcgaatacctgacccacgacaagggctacgcccgtcgcttgaccaacttcggcaagatcatcaacccgctgggcatccgcaccgtgggcgagttccccaacctcaccgagaccctgctcaagcgcggtcactccgagcgtgtggtgcgcaagatcatgggcgagaactgggtgaacgtcctcaaggacgtctggggcgaataacgccaaccctccacagcacacacctgtagccgctgccgaaggctgcgatcggctccgaaggagacgcgctcctgcggccctcggaaggctcttcgagccttatcgcagccttcggcagcggctacggatgcaccaatccaaaagaattccggagttttgaaacatggccaagatcgccccgcaactgcccatcgaagtcgacagcgaaaccggtgtctggacctccgacgccctgccgatgctgtacgtgccgcgtcacttcttcgtcaacaaccacatgggtatcgaggaagtgctgggcgccgacgcctacgccgagatcctttacaaggccggctacaagtccgcctggcactggtgtgaaaaagaagccgaatgccacggcctggaaggcgtcgcggtgttcgagcactacatgaagcgcctgtcgcagcgcggctggggcctgttcaagatccaggacatcgacctcgacaagggcaccgccagcgtcaagctcgaacactcggccttcgtctatgtgtacggcaaggtcgggcgcaaggtcgactacatgttcaccggctggttcgccggcgccatggaccagattctggccgcccgcggtagcaagatccgcaccgtcgccgaacaggtctacggcggttccgaagaaggccacgacgatggcctgttcaccgtcaagccgttgtaagcggagttaagaaaaatggctttcgaagcgatgttccagccgatccagatcggcaaactgaccatccgcaaccgggtgctcagcaccgcgcacgccgaggtctacgccaccgatggcggcatgaccaccgaccgctacgtgaagtattacgaagagaaagccaagggcggtatcggcctggcgatctgtggcggctcgtccgtggtggccatcgacagcccgcaggaatggtggagctcggtgaacctgtccaccgaccgcatcattccgcacttccagaacctggccgacgccatgcacaagcacggcgccaagatcatgatccagattacccacatgggccgccgctcgcgctgggacggtttcaactggccgaccctgatgtcgccgtcgggcatccgcgaaccggtgcaccgcgccacctgcaagaccatcgaggtggaagagatctggcgggtgatcggcaactacgcgcaagctgcccgtcgcgcaaaggctggtggcctggacggcgtcgagctgtccgccgtgcaccagcacatgatcgaccagttctggagcccgcgggtcaacaagcggaccgacgaatggggcggcagcttcgaaggccggatgaagttcggcctggaagtgctcaaggcggtacgcgccgaagtcggcgacgatttctgcgtgggcatgcgtatctgcggtgacgagttccacccggacggcctgtcccacgaggacatgaagcagatcgccaagtattacgacgacaccggcatgctcgatttcatcggcgtcgtgggttcgggttgcgatacccacaacaccctggccaacgtgattccgaacatgagttatccaccggagccgttcctgcacctggccgccgggatcaaggaagtggtcaaggttccagtactgcacgcgcagaacatcaaggacccgaaccaggccacccgcatcctcgagggtggttacgtcgacatggtcggcatgacccgtgcgcacatcgccgacccgcacctgatcgccaagatcaagatgggccaggtcgaccagatcaagcagtgcgtgggtgccaactattgcatcgaccgccagtaccagggcctggatgtgctgtgcatccagaacgccgcgacctcccgtgaatacatgggcgtgccgcacatcatcgagaagtccaccgggccgaaacgcaaggtggtggtggtcggcgccggcccggccggcatggaatcggcgcgggtggcggccgaacgtggccacgacgtgaccctgttcgagaagaaagaggccatcggcgggcagatcaccactgcgtcgaaagcgccgcagcgcgaccagatcgccggtatcacccgctggtaccagctggagctggcacggctgaaggtcgacctgcgcctgggcaccgcggccgatgccgagaccatcctcgacctgcgtccggacatcgtggtgctggccgtcggcgggcatccgttccttgagcagaacgagcactggggcgccgccgaagggctggtggtcagcagctgggacgtgctcgacggcaaggtcgcgccgggcaagaacgtgctggtctacgacaccatctgcgagttcaccggcatgtcggtggccgacttcctcgccgacaagggcagccaggtcgagatcgtcaccgacgacatcaagccgggcgtggccatcggcggtacgtcgttcccgacctactaccgcagcatgtaccccaaggaagtgatcatgaccggcgacatgatgctggaaaaggtctaccgcgaaggcgacaagctggtggcggtgctggagaacgaatacaccggcgccaaagaggagcgggtggtcgaccaggtagtggtggagaacggcgtgcggcccgacgaagcgatctactacgcgctcaaggaaggctcgcgcaacaagggccaggtcgacgtcgaagcgctgttcgcgatcaagccgcagccttcgttgagccaggcgggcgacggttatctgctgttccgcatcggcgactgcgtggcgcagcgcaacacccacgcggccatctatgacgccctgcggatctgcaaggatttctaagccatacctgtagccgctgccgaaggctgcgatcgactgcgaagcagtcgtgctcttgagttcgcagggaagtcctgcggacttcatcgcagcctgcggcagcggttacaacgaccgagctggtctttgggagctccaccatgttgaacacccttcttcccatcctgctgttcgcagccatcggcctggctgtcctgggcgcgttgcggcgggtggccatgtggcgccggggccgtgcgtccaaggtcgacctgatcggcggcctgctggccatgcccaagcgctacatggtcgacctgcaccatgtggtggcgcgggacaaatacatcgccaacacccacgtggccacggccggtggcgccgtggcgtctatcgtgctggcgatcctggtgcacggtttcggcctgcataaccgcatcctcggctacgccttgctgctgatgtcggcggtgatgttcgtcggcgcgatcttcgtctacctgcgccgtcgcaacccgccggcgcgcctgtcgaaaggcccgtggatgcgcctgccgaaaagcctgctggcgttctcggcgtcgttcttcctggtgaccctgccggtggccgggatcctcccggaaaacttcggcggctgggtactggccgcgatcctcggcatcggtgtgttgtggggcgtgtccgagctgttcttcggcatgacctggggcggcccgatgaagcacgccttcgccggtgccctgcacctggcctggcaccgccgtgccgagcgttttggtggcggccgttccaccggcctcaagccgctggacctggaggacccgaacgcgccgctgggcgtggaaaaaaccaaggacttcacctggaaccagttgctcggcttcgacgcctgcgtgcagtgcggtaaatgcgaagccgcgtgcccggcctttgccgccggccagccgctgaacccgaaaaagctgatccaggacatggtcgtcggcctggctggcggtaccgatgccaagttcgctggcagtccttacccaggcaagcccatcggtgagcacagcggcaatccgcaccagccgatcgtcaacggcctggtggacgccgagaccctgtggtcctgcaccacctgccgcgcctgcgtcgaggaatgcccgatgatgatcgagcatgtcgatgccatcgttgacatgcgccgtcacctgaccctggaaaagggcgctaccccgaacaagggcgccgaagtcctggagaacctgatcgccaccgacaacccgggcggtttcgccccgggtgggcggatgaactgggcggcggacctcaacctggcgctgctgggcgagaagaaaaccaccgacgtgctgttctgggtgggcgacggtgccttcgacatgcgcaaccagcgcaccctgcgcgccttcgtcaaagtgctgaaagcggccaaggtcgacttcgcggtactgggcctggaagaacgcgacagtggcgacgtggcccggcgcctgggcgacgaggcgaccttccagctgctggccaagcgcaatatccagaccctggccaagtacagcttcaagtgcatcgtcacctgcgacccccacagtttccatgtgctgaaaaacgaatacggcgccctcggcggcgagtacgtggtgcagcaccacagcacctacatggccgagctgatcgccggcggcgccctgaatctgggccagcacaaaggcaacagcgtgacctatcacgacccgtgctacctgggccgctacaacggcgagtacgaggcgccgcgcgaggtcctgcgcgccctggggatcgaggtcaaggaaatgcaacgctccggtttccgctcgcgctgctgcggcggtggcggcggcgcgccgatcaccgacattccgggcaagcagcggatccccgacatgcgcatggacgacatccgcgaaaccggcgccgagctggtggccgtgggttgtccacagtgcactgcgatgctcgaaggcgtggtcgaaccgcgtccgctgatcaaggacatcgctgaactggtggccgatgccttgctcgaagacgccgcgcctggcaagccggtgaccccggccaaacgtgaacctgcggaggcccactgatgagcgacattatccgccgcgacccgcgggccgaatggatcgcccgtaaccgcctgcatccgctgcacgcggccatgcaaccggcgcagcacagctggatggggcccaacggcatcatccgcaagaacccccacgggatcggtttcatcggccccaacggcatcaagcgcatcgaccgcagcggcgcccagccgggcggggcggtcaagcgcagcgccgcggtcgaagtccagctgccgctgcatcaggtggcgcagccggcgttctacatcagcgtggtgccggatatggtcggcggccgcctgagcagccacgaccgcgacctgctgggcctggcccatcagctggccggcaaggacggcgcggtgctggcggtggtgtttggcgagcacaaggaaaacgccttcgccacggccggcgtcgaccgcctgctggtgctcgaaggcaacgagttcagcggttatgcaccggaacagcgagtccagggcctgcgggctgtggataaccagttcagcccacgccactggttgctgcccgacagccgcaccggtggcggcgaactgggccggcgttttgccgcggccctgggcgaacgcccggctacgcgggtctggcaggtcaaggacgagcaatgcatcggccgcgccggtgccggcttgcaggacctggcgcgaccgctggcgcgcttgatcctggccgccgccgaatgcgcggaaccggtcagtgaaacccgccacgaagctctgccggtggagttatccacagcggtggcgcgcagcctggcgcgaatcgaggacctgggcgcggtggcggtggacccggcggcgattcccatggccgaggccgagttcattttctccggcggcaacggggtcaaggactgggagctgttccacaggaccgccgcggccctgggcgccaccgaaggcgcgtcgcgggtggcggtggacgacggtttcatggcccgcgaccgtcaggtcggcgcctcgggcacctgggtcaccgcccgggtgtacgtggcggtggggatttccggggcgatccagcacctgcagggtatcggtgcctgcgacaaggtggtggcgatcaacctcgatccgggctgcgacatgatcaaacgcgccgacctgtcggtgattggcgaaagcgccgagctgcttcaagccttgatcgcggcggtagaggcctaccgcaacggcgccaagcgcgatgcggcttaagggaaggacagagcttatgagtaccaatgtgatcagcctggtgtccatcggcgcccacccgacttccggccggccacggcgcgccgagcaggatgcgcgggcggtcgagctggggctgcaactggccggggacaggctgcaggtgctgcacgccggcgatatcgccgagccggccctgcgcgcgtacctgggcatgggcctggaacagatgcacgtgctggagcagtcggccggtgccgatgcgctgccggcgctaaccgattatctgcgcgatgccggggcgcaagtggtgctcaccggcagccaggcggaaaccggagaaggttcgggcatgctgccgttcctgctggcggaaaacctcggttggccactggtggtgggcctggcccaggtggagtccatcgacggcggcgtggccctggtgctgcaagccctgccgcgcggccagcgccgtcggctgaaggtgcgcctgccgttcctcgccactgtggataacgccgcgcccaagccacggcagagcgcctacggcccggcccggcgtgggctgctgcaggctcggcaggtggaagtgctcgacgatgagttgttcaccagcgccaccctgcaaccggccaaaccgcggcccaagcgcctgaaagtgatcaaggccaagagcggcgccgaccgcatgaaagccgcgaccgccaaggccagcggcggtggcggccaggtgctcaagggcgtcagcgccgaagccggggccgaggccatcctcaagctgctgatcgaagagggtgtggtccgctagggtcgggccagccgttgtaccgttatcgcgagcaagctcgctcctacagggatgtgtgagtcccatgtaggagcgagcttgctcgcgataaatcctccaaacgccacataccccacggttacccacaatccctgtgcgcgcctctgtggataagatgttcgtccctctctgcaagcctcgccaatcaagcgctacagcgcgttgtacgaaaaacgatcaagctaagtcgaggtttttccgaaggtttttctgtggataaggaattccctcggtcctctgccgctgccgagttgcccccaaagtctgttggcctctttgtggataagatgttcgctctccgctgagagccttataaacattggtctgcagaggtctgatcaaaaaacaggcaaatccgcggttttgcctcgccggcggccctgaagccttgatatttcgcgctattcggcggttttccacagctcgctgcccttggccgcaaagttgcccccaaagtctgttggcgcttctgtggataaggtgttcgccttcgtctgcgggcctttaataacgtggcttgcagagtgttgttcaaaaaatgatcaaagccttgtggaaaaggcctttccggataagtcacggattttattcaggttctgccagtgaatccgccggctgagagccgagttgcccacatttgctgtgggtggagatgtggataacttgttcgcggaaggctgggggccttgtcggccatggccgggagggattccgatcaaaaaacgtacagcaagcttgcccctgtaggagagcagcttgctcgcgatgaacgctaacgcggtggttcggtacaccgtgtcgcggccttcgcgggcaagcctcgctcctacagaagcccagcccgggatcagccgtgaaccggcacgcccttgaggtacggagccggttcggcgccgaggttgctcagcatgcgctcgctgtaccaatccacgaagttgaccacgccgaactcgtaggtcttggagtacgggcctggctggtaggcggtggagttgatgccgcgctggttctcttcggccaggcgacggtcctggtcgttggtggcgtcccacacctggcgcatgcgcgcgacgtcgtagtccacgccttcgaccgcgtccttgtgcaccagccacttggtggtgaccatggtttcctgggcgctgatcggccacacggtgaacacgatgatgtggtcgcccatgcagtggttccacgagtgcggcaggtgcaggatgcgcatcgaacccaggtcggggttcttgatccggcccatcagcttggcgcagccctgcttgccgtccatggtcatggacacggtgcccttgagtagcggcatgcgcacgatgcggttgcgcaggccgaagctggcgtgggcataagggatcttctcggcttcccaggcagcggccgaggcggccacgtggtccttgaacgcctggtcggcgcgcgggtcggtgacgtcgtcccactccagcagggtcttcagcagttccgggtgcgcaccgccgcagtggtagcactcgcggttgttttccagcaccagcttccagttggccttttccatcaaggtggtttgcaccgccaccttggtgttctccatgtcgtagggttccatgtagtgcgtcagggtcgccaggaagtcatcgatggccggcgggttctcggccagcgagatgaagatgtagcctccggcggtcttcacgttcactggcttgaggccgtactgcttcatgtcgaagtcggcgcccatctcggtgccggcgaacagcaggcgaccgtccagctcgtaggtccactggtggtagtggcagaccagcttggcgaccttgcccttgtcgctggtgcacaggcgcgaaccgcggtggcggcagacgttgtggaaggcatggactacgccgtcggcgccacggatcacgatgatcgggttcttgccgacctgcagggtcatgtagttgcccttggtcggaatctcgcaggtcatgccggcgatcagccattccttctggaagatctcctgcatgtcgatatcgaacaggcgctcgtcgcagtagaacggctgcggcagggaaaaggtgcgctcgcgttcttggagcatttgtgcggtggccttgcgtgcgggttccagcggatcgcccaggctcagggttgcggtgacgtccatcgttttggtcctcatggccatctgtgtggccggcgaaagtggctacggttggtgcgacgcaaggctgaaaaatcagcggttatcagttgaggcgagtgtggggccggcgcggcccggaaccttatccatgggcgacatggcccaatctgttcccgacgcgcaagccccggtggttgggggctggtcgcgataagtatgtgaatgtcgcagataggtaaatgggtgttcatgggcctgcgcacaatcgccaccataaaggccggcagtcggccgtggagatcagcatgtccaacaacttcctgaacccggtaaccacccagacctgggccaatggccgacacatcgtccgttgcgtcaaagtcatccaggaaacctgggacgtgcgcaccttctgtttcatggccgaccagccgatcatgttcttcttcaaaccggggcagttcgtcaccctggagctggagatcgaaggccagccgatcatgcgttcctacaccatttccagctcgccctcggtgccgtacagcttctcggtgaccatcaagcgcgtcccgggcggcaaggtctccaactggctgcacgacaccctgcacgaaggccaggaactggcggtgcacgggccggtggggttgttcaacgccatcgacttcccgagcccgaaagtcctctacctcagcggcggcgtcggcatcacgccggtgatgtccatggcgcgctggttctacgacaccaacggcaatgtcgacatggtgtttatccacagcgcccgttcgccgaaggacatcatctatcaccgcgagctggagcacatggcgtcgcggatcgacaacttcagcctgcacctgatctgcgagaaacacggcctgggcgagccctgggccggttatcgcggctacctgaaccacaagatgctggagctgatggcgccggacttcctcgagcgcgaagtgttctgctgcggcccgacgccgtacatgaacgcggtcaagcgcctgctcgaagccagcggcttcgacatgtcgcgctaccacgaggaatccttcggcgcgacgccggcggaagcccgtgccgacgccgtggaacaggccgagcaggccgccgaggcgccggaaatcgatatcgccgacctgcaccaggtggagttcacggcttccggcaagagcatccgcgtggcgccgggcgagaccgtccacgccgccgcggccaagctcggcctgatgatccccaaggcctgcggcatgggcatctgcggcacctgcaaggtgctcaagctgggcggtgaagtggagatggaccacaacggtggcatcaccgaggaagacgaagccgaaggctacatcctgtcctgctgcagcgtgccgaagggggatgtgcgggtcgagtattgagcgtcggacccataacccgtagccgctgccgaggcacgaggctgcgatcgactgcgaagcagtcgtaaaaccggacagcccgttctttctggaacaccgcgtgctcaggttttgcgaggactgcgtcggaatgccgcccacctcgcttgcagcctcgcgggctcggcagcggctacagattgatccgctcgctcaatcgataaacagatccgtcatcagcgtttcgctgctgtcgggatcgaagcggtaatgggcgaagtcgctcaccccctgttcgcgcagtatttcctcgtctatcagcaagcgcccggtgatgcggcgctggctgccggagaggatcgcgtgggccgcatcggccatgattgcaggcgtgcgcgcatgtttgaatgactcgcgcgaacccaattggaactcgatggcggccgtggcgatcatggtctgcggccacagcgagttgacgctgatgccatagttcttgaattcctcgttcatgcccagggtcagcatgctcatgccgtacttggtcacggtgtaggggctgtactgggcgaaccatttgctcgccaggttcagcggcggcgacaggttgaggatgtgtccgccgctggttttcaggtagggcagggccgcctggctgcacagcagcacggcgcgggtgttgatctggtgcatcaggtcgaagcgcttgagctcgatgtgctgcaccccggtcagcttgatcgccccggcattgttgaccagcgcatcgatgccgccgaactgctcggcggccttggccatggcctggcgcaccgtctcttcgtcacgcacgtccacctgcaacgccagggccttgccgcccgccgcctcgacctcgcgagccacgctgaagatggtgccgggcagcttgggatgggggtcggcgcttttggccgcgatcacgatattggccccgtcccgcgccgcccgcagggcgatttcacggccgatgccacgactggcgccggtgatgaacagggtcttgccttgtaaggacatggatgcgctcctgattattgtcgttatccgagcgggtacagcggctcgccagacaatctagttcatgtctggcggcgcgcgcggatcaggggcgaaaaggcgaagggccgcgagcgttgcccgcggtcggggagggctcagtacaacgctgggcggcggtccagatgcacgtggttatgggcgctgatgtgcttgtgccgggcgtccgccaggggcagctccgccagcagcagttgctgctggggctgacgggcgctgccggccagcggataaccgtcggcgtcgacgatcagcgagccgccgacccaggccacgccacgctcctcgccgcagcggtcgcaagcggcgatgaacatgcggttgaccgcggcgttggcctggacccggaccatttccgccgggcgttcacccgccggacgcggcccgtccggccagttgaccggggcgcagagcagggcggcgccggccagcgcgggcaggcgcacccattccgggaactccaggtcgtagcagatcagcatcgcgatcgcgccaaaacgggtttccaccaccggcggcggttggtcgccgacagtgaacaccagcttttcccggtcccacagatgggccttgcggtacaccgtcacccgcccctcgggctcgaccagcgcggcgctgttggccacttgcccggcattcaggcgctcgcagaaaccgccgacgatcaccacctgcagctctgcggccagggccttccacagggtcagcgtcggcccatcgaggacctcggacagcgccagcgcttcctgccgatcggtgaacacataaccgctctgcaccagttccggcagcaccaccacctgggcgccctcggcagcggcctcgcggatggcccgctggcccagctcgcggttgtagtcgagctcgcccacccgtggggcgatctgctggcaggcgactttcagggtgggcaatccagtcattggccggctccttccagttggcgttcgctggcctggatcgccaggcgctcggcgtccaggtccaggccacgggtcagcgcccagtaggccacgccggccacggccaggccgatgacaaaggcaatgtccgcgccctccagcgcccgggctaccggaccctggtagaagctcagggatatgaacggaatcatcgcgatcaggccgaggaaataggcgatgagcccgggcatggcccagcgcccatagatgccggccgggttgaagatgtcgctgatggcgtagtgacctttgcgcaccacgtagaagtccgccaggttgaccgcggtccagggcaccaggaaatacagcatcagcagcacgaaggtgttgaagctcgccaggtagctgtcgggaatgttcatggcgatcaggaaaatcaccaccgccaccagggcgatgcccaccacccggctcttgagattcggctggatttgcaggaagccgtcgatggcgctgatgccggtgagcatcgcgccgtagcagttgaccgccatgatgccgaccagggcgggcacggcgatcagcacggtaaaggtgccgaagcccgggatcatctggttgccgacttcgcggacgctgccgatggcgtcgggggacggcagggcggaggcgaggaaggcgcccagggacatcagccacagcgccgagcccgcggcgcccagataggtccagaaaatcacctggcgcgacgaggtcttgtgcggcaggtagcgcgaatagtccgagacatacaccgagtagctgatctggtagccggcggccgccgacagctggatcaggaacgccgaccaggagaagtgcgcatcggccacggcggcgtcggcctgcagggtcatcagcgcgctgatggtcagcacggtgaacacgctgatcatgatgtaggtcagccagcgctgcacggcgtgcagcaggtcatgcccgaccacggcgatgatcaccgcgaggatgatcatcaggctgtaccagggcgcccgcgcgccaggcaccacggtgttgatggcgtcggtggcgaggatcacgttgaacacgttgaagccgatgtagacgaagaccaccgcggtgaagggcacgatggccccgcgcaggccgaattgcgcccgcgactggatcatctgcggcaggcccatgcgtggcccctggttggcatggaaggccatgcagaaggtgcccaggcagacgccgaggacgatggccaggatcgagtagtgcaggctcaggccgagggcggcgccggtgaagccggtgaccatggtggtcaggacgaagttgccggtgaaccagaacggaccctggtgccagaccttgccgtggcgctcgtggcgcggcacgtagtcgatggagcgggtttcgatcttgaggctgggggacggggctttttccgttgccgcgggcaggctggtcatggggctgtgccttgtttttataaattgaccccggagtctcggatatacgcctgtgatgttgaatcagtggagggaaataatcagttcaggaatttgtgaactgatgtcacgcagcgccggcccaccgctcccgatctcgacaggaggcggcaggccggcgagggcattcagccggccatgacctggcgaatgtccgcggccagttcgcggacccgcgcttcttcggtgtcccacgagcacatgaagcgcgcgccgcctttaccgatgaaggtgtagaagcgccagcccttggcggtcagcgcggcgatggccggttccgacagttgcaggaacacgccgttggcctgcaccgggaacatcagttccacccccggaatgtccgccaccagctcggccagcaattgcgcgcaatggttggcgtggcgggcgtatttgagccaggcgtcgttttccagcaggccgacccagggcgcggacaaaaaacgcatcttcgaggccagctggccggcctgcttgcagcggtagtcgaagtcttcggccagcttgtggttgaagaacaggatcgcctcgcccaccgccatgccgtttttcgtgccgccgaagcacagcacgtcgaccccggctttccaggtcaggtcggcgggcgagcagccaaggaaggcgcaggcgttggagaaccgcgcgccgtccatgtgcaggttcagccccagctctttgcaggtggcgctgatggcgcggatttcttccggggtatagacactgccgacctcggtggcctgggtcagggtcaccacccgtggcttggggtagtggatgtcctggcgcttgagggcgatgtcgcggatcgagtccggggtcagcttgccgttctcggtgccggcgatcagcagcttggagccgttggagaagaattccggggcaccgcattcgtcggtttcgacgtgggcggtttccgagcagatgacgctgtggtaactctggcacagcgacgacagggccagggagttggcggcggtgccgttgaaggcgaaaaacacctcgcagtcggtctcgaacagcttgcggaaataatcggcggcgcgcgcggtccactggtcgtcgccataggcgcgctcgtggccgcggttggcctggtccatggccgcccaggcctcggggcaaatgccggaatagttgtcgctggcgaattgttggctcttgtcggtcatggccgtcttccgtgctaagggtccgagaggggagtccttcgataaagggctccggataaggcgctcctgggtaaggagcccttgggtaaagcgtccgcaacgaggtctgggccagcaggacagcgcaggccccgcagagatcggtggagcgccactttacccaagattgaggggggagcacaggctctgtttatgggtgaaaaatgcacaggccatgaggatatatgccagacccgctgctgaccccgctggccgcccggcgcgatggcgccctggacctgctcaagtggctggcgctgctgagcatgctgctcgatcacctgcgctacgtcggctggagcctcgatctgctgtatgtgcccgggcgcctggcgtttccctggttctgcctggcgctggcggccaatgtggcgcgggccggcgcggtggatcgcgagggcgcggggcaatggcgttacctgggctggctgctgttgttcagcctgctcagcgaggtgccgtaccggctgtacattcccgaccccgacaccctgaatgtgctgccgaccctggccctgggcctgttggtggcccgcgcctggcagcgtcgcggcgggctggcgctgtggctggggatcggcgcggccttgctcggcgggctgttcgaccgctacctgatgttcggcctgttcggcgtcttgctgccgctggcgatgttgctggtgctgcagcgccgctggtactgggcgctgctgccggggctgctgtgcctggcggccaaccagtggcaaagcctgctgccggcggcgcgcctgggtaatcaggtggccgcctgggcgttgctcgcctgcgtgctggcgccgtggctggggctggcgatcctgcgccggatgcgcggtttttcgccgccaccgatgcggcgctgggcctatctgctgtaccccgggcagtttcctcctgctgctgatgctgcgcaacctgctggcgtgacggcgaaccgttgtcgctacgaacgtcctgtagccgctgccgagctggcgaggctgcgctcggccgcgaagcggtcgtaaaaccaggcaacctgttcttccaggcatatcgcgtgctcaggtttttcgaggactgcgtcctcgagcgcagcctcgcaggctcggcagcggctacagaggcgacacgccaacccgaaagctgtggcgccactggtcggtggcgggggctggcggtcgcgggcaagccaccgatatagagccttcggcgcgtggcgcccgcaagcaattgtctctctgcgccaggccatgtcgtaaacgcacctttgcgtggcgtccataggcatttggccggtcagcgccggtcataccatcgcatccaaagggcactaccgcagggtacgtgcctcaccgagacgaaaggcgcaccgccgccgctgggagagacgcgatgttcagcaagcaagaccaaatccagggttatgacgatgcactgctggcggccatgaatgccgaggagcaacgtcaggaagatcacatcgagctgatcgcgtcggagaactacaccagcaagcgcgtgatgcaagcgcaaggcagcggcctgaccaacaagtacgccgaaggttatccgggcaagcgctactacggtggctgcgagcacgtggacaaggtcgaggccctggccatcgagcgcgccaagcaactgttcggcgccgactacgccaacgtccagccgcactccggttcctcggccaacagcgccgtgtacctggccctgctgcaagccggcgacaccatcctgggcatgagcctggcccacggcggccacctgacccacggcgccaaggtgtcgtcctcgggcaagctgtacaacgccgtgcagtacggcatcgacaccaacaccgggctgatcgactacgacgaagtcgagcgcctggccgtcgagtgcaagccgaagatgatcgtcgccggcttctcggcctactccaagaccctcgacttcccacgcttccgccagatcgccgataaggtcggcgcgctgctgttcgtcgacatggcccacgtcgccggcctggtcgccgctggcctgtacccgaacccgctgccttacgccgacgtggtcaccaccaccacccacaagaccctgcgcggtccgcgtggcggcctgatcctggccaaggccaacgaagaaatcgagaagaagctcaacgccgcggtcttcccgggcgcccagggcggcccgctgatgcatgtgatcgccggcaaggcggtgtgcttcaaggaagcgctggagcctggcttcaaggcctaccagcagcaagtgatcgacaacgcccaggccatggccggcgtatttatcaaacgcggctacgatgtagtgtccggcggcaccgacaaccacctgttcctggtcagcctgatccgtcagggtctcaccggcaaggatgcggacgccgccctggggcgcgcccatatcaccgtgaacaagaacgccgtgccgaacgatccacagtcgccgttcgtgacctccggcctgcgtatcggcaccccggcggtgaccacccgcggcttcaaggttacccagtgcgtggagctggccggctggatctgcgacatcctcgaccacctcggcgatgccgatgtcgaggccaatgtcgctcgtcaggtatcggccctgtgcgcggacttcccggtttatcgctgagtgcggttttggagtaaatgactatgcaacgctactcgggcttcggcctcttcaagcactccctcagccaccatgaaaactggcagcgcatgtggcgcacgccaaccccgaaaaaggtctacgacgtggtcatcgtcggcggtggcgggcatggcctggcgaccgcctactacctggccaaggagcacggcatcactaacgtcgccgtggtcgagaaaggttggctgggcggcggtaacaccgcgcgcaacaccaccatcgtgcgttccaactacctgtgggacgagtcggcgcacctgtacgaacacgcgatgaaactgtgggaaggcctgtcccaggacctcaactacaacgtgatgttctcccagcgcggcgtctacaacctgtgccacaccctgcaggacatccgtgattccgagcgtcgggtcagcgccaaccgcctcaacggcgtggacggcgagctgctcaacgccaagcaggtggcggacgagattccgtacctggactgctccaagaacacccgctacccggtgctgggcgccaccgtccagcgccgtggcggcgtggcccgtcacgacgccgtggcctggggctttgcccgcgccgccgacgccctgggcgtggacctgatccagcagaccgaagtgatcggcttccgcaaggaaaacggtgtgtgcatcggcgtggaaaccaacaagggcttcatcggcgccaagcgcgtcggcgtggtcaccgccggtaattccgggcacatggccaagctcgccggtttccgcctgccgatcgaatcgcacccgctgcaagcactggtgtccgagccgatcaagccgatcattgacagcgtgatcatgtccaacgcggtgcacggttacatcagccagtccgacaagggcgacctggtgatcggcgccggtatcgacggctgggtcggctacggccagcgcggttcgtacccggtgatcgagcacaccatccaggccatcgtcgagatgttcccgatcctttcgcgggtgcgcatgaaccgccaatggggcggcatcgtcgacaccaccccggacgcctgcccgatcatttccaagaccccggtgccgaacatgttcttcaactgcggttggggtaccggcggcttcaaggcaacacctggctcgggcaacgtattcgccgcgagcctggccaagggtgaaatgcacccgctggccgcacctttctccatcgaccgtttccacaacggtgcgctgatcgatgaacacggcgctgcagctgtcgcccactaacaggagaaatccctatgttgcacatcttctgtcctcactgcggcgaactgcgctccgaagaggaattccattcgtccggccaggcgcatatcccgcgtcctctggatccgaacaactgcaccgacgaggagtggggcgactacatgttcttccgcgataaccctcgcggtctgcaccacgagctgtggatccatgccgccggctgccgtcagtacttcaacgccacccgcgacaccgtgacctacgagattctcgaaacctacaagatcggtaccaagccacaattcaccgacaagaccgatagcccgaaagcggccacgcaggctctgggagagaaggtatgagccagtccaatcgcctgtccaacggcggacgcatcgaccgcaacaaagtcctcagcttcaccttcaacggccagacctacaaaggcttcgaaggcgacaccctggccgccgccctgctggccaacggcgtggacatcatcggtcgcagcttcaagtattcccggccgcgcggcattttcgccgccggtgccgaagagccgaacgcggtgctgcagatcggcgccaccgaagccacccagatccccaacgtgcgcgccacccaacaggcgctgtaccagggcctggtcgccaccagcaccaacggctggccgagcgtcaacaacgacatgatggggattctcggcaaggtcggcggcaagctgatgccaccgggcttctactacaaaaccttcatgtacccgcaatcgttctggatgacctacgagaagtacatccgcaaggccgcgggcctgggtcgctcgccgaccgagaacgatccggacacctacgactacatgaaccagcactgcgacgtgctgatcgtcggcgccggccccgccggcctggccgcggccctggcggctgcgcgcagcggtgcgcgggtgatcctcgccgacgagcaggaagaattcggcggcagcctgctggacagccgcgaaagcctggacggcaagccggcggcagagtggatcgccaccgtggtcgccgagctgaagtcgctgccggacgtgaccctgctgccacgggccaccgtgaacggctaccacgaccataacttcctgaccattcacgagcgcctgaccgaccacctcggcgaccgcgcacccatcggccaggtgcgccagcgcatccaccgggtgcgcgccaagcgcgtggtgctggccaccggcgcctgcgagcgtccgctggtctacggcaacaacgacgtgccgggcaacatgctggccggcgcggtctcggtctacgtgcgtcgctatggcgtggcgccgggcaagaagctggtgctgagcaccaacaacgaccatgcctaccgtgtggccctggactggctcgacgccagcctgcaagtggtggccatcgccgatgcccgtcacaacccacgtggcgcgctggtggaagaagcccgcgccaagggcattcgcatcctcacctccagtgcggtgatcgaagcccgtggcagcaagcatgtgaccggcgcccgcgtcgcggcgatcgacgtcaaggcccacaaggtcaccagcccaggcgagtggctggactgcgacctgattgccagctccggcggctacagcccggtggtgcacctggcttcgcacctgggcggcaagccgatctggcgtgaagacatcctcggtttcgtaccgggcgaagcaccgcagaaacgcgtatgcgtcggcggcatcaacggcgtctatggcctcggcgattccctggccgacggtttcgaagggggcgtgcgcgctgccagcgaagcgggtttcaaggccgtggaagcggtactgcccaaggccctgagccgtgtggaagagccgaccctggcgctgttccaggtgccccatgaaaaaggcaccgcgcgggcacccaagcaattcgtcgacctgcagaacgacgtcaccgccgccgccatcgaactggcgacccgcgagggcttcgagtcggtcgagcatgtcaagcgctacaccgcgctgggcttcggtaccgaccagggcaagctcggcaacgtcaacggcctggccatcgcggcccgttcgctgaacgtgagcatcccgcagatgggcaccaccatgttccgtccgaactacacgccggtgactttcggcgccgtggccggccgtcactgcgggcacatcttcgagccggtacgcttcaccgcgctgcatgcgtggcacgtgaagaacggcgccgagttcgaggacgtcggccagtggaagcgcccctggtacttcccgaagaatggcgaagacctgcatgccgcggtcaagcgcgagtgcaaggcagtgcgcgacagcgtcggcctgctcgacgcctcgaccctgggcaagatcgatatccagggcccggacgctcgtgagttcctcaaccgcatctacaccaacgcctggaccaagctcgacgtgggcaaggcgcgctacggcctgatgtgcaaggaagacggtatggtcttcgacgacggcgtgaccgcctgcgtcggcgaaaaccacttcatcatgaccaccaccaccggcggcgccgcgcgcgtcctgcaatggctggagatctatcagcagaccgaatggccggacctcaaggtgtacttcacctcggtcaccgaccactgggcgaccatgaccctgtccgggccgaacagccgcaagctgctcagcgaagtcaccgacatcgacctggacaaggacggcttcccgttcatgacctggaaagaaggcctggtgggcggcgtgccggcgcgggtgttccgcatttccttcaccggcgagctgtcgtacgaagtcaacgtccaggccgactacgccatgggcgtgctggagcagatcgtcgaggccggcaagaagtacaacctgaccccgtacggcacggaaaccatgcacgtgttgcgggccgagaagggcttcatcatcgtcggccaggacaccgacggctcgatgaccccggacgacctgaacatgggctggtgcgtcggtcgcaccaagccgttctcgtggatcggctggcgtggcatgaaccgcgaagactgcgtgcgcgaccagcgcaagcagctggtgggcctgaaaccgatcgacccgaaccagtggctgccggaaggcgcgcagctggtattcaacaccaagcaggcgatcccgatgagcatggtcggtcacgtgacctccagctatgcccacaactccctgggttattcgtttgccatgggtgtggtcaagggcggcctgaagcggatgggcgagcgggtgttcgcgccattggccgacggcacggtgatcgaggcggaaatcgtttcttcggtgttcttcgatccgaaaggcgatcgccagaacgtttaacaaagatccatgtagccgctgccgcaggctgcgataaggttcgaagaaccttccggcgccatcaagagcggcgcctgcttcgcagtcgttcgcagcctgcggcagcggctacaggatcggtggttttcgcacaacagaattcaagacaggtgctctatgaccgcagtcaacgtttaccaacagcgcccgaccactggcgccaaagccgagtcgtcgctgcaccatgccgacctcgccagcctggtgggcaagggccgcaagaacgcaggcgtgaccctgcgcgagaagaaactcctcggccacctgaccatccgtggcgatgctcatgacccggccttcgctgccggcgtgcacaaggccctgggcctggagctgccagtggccctgaccgtggtcgccaagggcgaaaccagcctgcagtggatgggaccggacgagtggttgctggtggtgccgagcggcgaagaattcgccgccgagaaaaaattgcgcgaagccttgggcgacctgcatatccagatcgtcaacgtcagtggcggccagcagatcctcgaactgtccggcccgaacgtgcgccaagtgctgatgaagtccaccagctacgacgtgcaccccaacaacttcccggtgggcaaggccgtcggcactgtgttcgccaagtcgcaactggtgatccgccgcatgggtgaagacacctgggaactggtgatccgccgcagcttctccgattactggtggttgtggctgcaggatgccgccgccgaatacggcctcagcgttcaggcgtaacacaaatccctgtagccgctgccgcaggctgcgatcgaccccgcagggggcgtcgctcttgagggcgctggaaggtccttcgaccaacgtggcccggacttatcgcagcctgcggcagcggctacagaagtgtacttacgaacaggagtcaccccgcatgagccgcgcacccgatacctggattctcaccgccgactgccccagcgtgctcggcacggtggacgcggtgacccgctttctgttcgagcagggctgctacgtcaccgagcaccattctttcgatgaccggctttcggcgcgttttttcattcgcgtggaattccgccagcccgagaatttcaacgagcagggcctgcgcgacggtctggccgagcgcgcccgggctttcgacatgaacgtcgaactgaccccgccgcagcatcggccgaaagtagtgatcatggtctccaaggccgatcactgcctcaacgacctgctctaccgccagcgcatcggccaactggcgatggacgtggtggcggtggtgtccaaccacccggacctcaagcccctggccgactggcaccagatcccgtactaccacttccccctggaccctaacgacaagccgtcccaggagcgccaggtgtggcaggtgatcgaggactccggcgccgaactggtgatccttgcgcgctacatgcaagtgctgtcgccggagctgtgccgcaggctcgatggcaaggcgatcaatatccaccactccctgctgcccggtttcaagggcgccaagccttatcaccaggcctacaacaagggcgtgaaactggtgggcgccaccgcgcactacatcaacaacgacctggacgaaggcccgatcatcgcccagggcgtggaagtggtggaccacagtcattaccccgaggacctgattgccaaggggcgcgatatcgaaggcctgaccctggcgcgggccgtgggttatcacatcgaacggcgggtgttcctcaacgccaatcgaacagtggttctatgacctgtagccgctgccgaaggctgcgatcgaccccgtagggggcgccgctcttgagggcccttcgaccaacgtggcccggacttgtcgcagcctgaggcagcggctacagcgaagcgattttgaagaacgaaacagcatctgtacccgagcactctacgcgctgcctttttccggcaacgcggtttcataaaaacaacagcgaggtgaaagcatgtctggtaatcgtggtgtcgtgtatctcggcaatggcaaggtcgaagtacagaaaatcgactatccaaaaatgcaggacccgcgcggcaggaagattgagcacggcgtcatcctgcgcgtggtatccaccaatatctgcggttcggaccagcacatggtgcgcggccgtaccactgcccaggtcggcctggtcctgggtcacgaaatcaccggcgaggtggtggagaagggcagcgacgtcgagaacctgaagctcggcgacctggtctcggtgccattcaacgtggcttgcgggcgctgccgttcctgcaaggagcaacacaccggggtctgcctgaccgtcaacccggctcgcgccggcggtgcctacggctacgtcgacatgggcgattggaccggtggccaggccgaatacgtgctggtgccgtacgccgacttcaacctgctgaagctgccggaccgcgacaaggccatggagaagatccgcgacctgacctgcctgtccgacatcctgccgaccggctaccacggcgcggtgacggccggcgttggcccgggcagcagcgtctacatcgccggtgccggcccggtgggcctggccgcggctgcgtccgcccgtctgctgggcgcggcggtggtgatcgtcggcgacgtcaacccggtgcgcctggcccacgccaaggcccagggttttgaaatcgccgacctgtccaaggacaccccgctgcacgaacagatcgccgcgttgctcggcgagccggaagtggattgcgcggtcgacgcggtgggcttcgaggcccgcggccatggtcattccggtgcccagcacgaagccccggccacggtgctcaactcgttgatgggcgtggtgcgggtcgccggcaagatcggtattcccggcctctatgtcaccgaagacccgggcgcggtggatgccgcggccaagatgggcagcctgagcatccgcttcggcctcggctgggccaagtcccacagcttccacaccggccagaccccggtgatgaagtacaaccgtcaactgatgcaagccatcatgtgggaccgcatcaacatcgccgaagtggtcggcgtgcaggtcatcagcctggacgacgccccgcgtggctacggcgaattcgacgccggcgtgccgaagaaattcgtcatcgacccgcacaagctgttcagcgcggcgtaaggctttggcgcagtaaaaagggcgaccctcgggtcgcccttttttatgtctgttttcgatgttcagaaacctgcgcccggatagtggagccagtactttccggacagtatttctgcaatatcgggtggagggaacacagacggcgcatctcggttgaagcgggagcgccattgcggaagccaccaatagttgagtgcggttcctctgggtttaaggacaaaccccagcactgtgtcatcgatccgcccctctttataaaacctgtggctgtgatccatgaggttcaggtaatggttgatgggcagcttcagcatcaggatcgaggtatagaccttctccgactgtgtgcgtgtcgggctttcaagcagaccgagcgcttcgcagtaatacgcttgcggctgctgggtgatgctgctggccgtgggttcggcgaggatatcgaagacgttggtgtcttcttgccaggctctttcattaccttgcttgaagtagtcggtaacgaaacgggtcagcgggccgttggctacggtttggcctgcacaggccaaatcatcgaccggtgaccagacgcgccaggccacgatggagatgagtgcaatggccaagagtggatacaggattcttttcattgtggtttgctgtgtttgtagcgacggaaaacagtaaagtcatgatcacccctggaggcggtgccattgaagtttcggaaacctgcatcattgacctcaacctttaaccagcccgcagatacacaaacccccttggcaacgacaaaaccaacgtgaccactcgcgtctgaataattggcggtgtaagcaccaatatcgccaggtagcggttgtgtctcgactttccagctattgagtaacttgtcaggattaccccactcggcagccaggggcggactcaggctaccattgcctggaagccatgtcagtcgaccatgttcaataagcgccacggaaataccgacagaagtgagaacgtcgtaaacgaacaagttgcatttgttagtgtttttcttgaatgaggtggttttctctagagttggatgaggtagcgattccttttcttttggtcctgcccaatcggtcgaaccacgatgggaaagtgctttcatcaatatttttctaggtatgtcatgaacggcgatttttaccgttctgatttcattgttattattctttactccgtactctactgagtagaagttatcattcgatggcgtgtcctgagtcgatagctggatttttgtccatggagataccgcaaccagatttaaccgatttcctacggttagcgtggcttttcctatggctttcttattgccggcggcactaacgataagcaaggaaacttcatatttcggcttgctttcaatggtagtcaaaactgcattgtcaggccccctgacaatcgtctcgagtttacgggcggtcagagtgtaggtaatcgttgattcttgttttttggtgatttttttatcgatgggtttgttatctataagaagctcgaaatgcacgccatctggcgtatccatcaggaagtctttaaagaccaatgtgatttctgatttcattgaggcaccttattcaataggttcttcgtaggagaaaaactcccaagtcgagtcatcacccacaaaaacagtatcgcaggaggaatagtcttcgacggggtgttcttttccctctccggttgtttggcaagtaccgtcgttgaataaggtaagttggtctttattctttatcttgtaggccagcccaggtttctctatatcatcctggcgctcgatgatgacttgtaggctttttggaaggcttgctctagaaagcaaagctatcccgctacccactggagcagagtgatctacaccagcaagtccgctgtgttgttgtgtgagtagggtattggtgaagggtggacagccacaggcgacatagtctccttcccgtgcggcgggacccgccggtaggtagaccgtcctttcccctacggcaacaatagggccctttccaatagcacaaaccgggcaactggctagttggccaaccgaactgataattcggccctctatgtatataccgtcgtttccctcaagaatgacaccgccagtagaggtaggacctcccttggacgctagctttcgtggatcagctgatgacatgggctccctcccatttaacgagcccggatctcacacttcgcttaatccatccggttttgtatctatacgtgacaaatattcgagatcggtggttacgcgagtgaaaatcgcaccattccagaaagcagtattcgctccagtttcaaaagcgtgagctggtgatgatgtacgctcaattgcagtccggggcactgcatttttcactccgttatagttactcggggatttactcgtgaccgggaacattcctattggccatcagtcaaatggctgctttttcccacccaatctcgggtggttttcatgctcaagaggttgtctcgatgaaaatttcccgcagtgttgcactggctacgttgctgaccctgggagccagcccggtttttgccgcaggcttcagcctgagcgatgccgccaatgcggtgtccagcatgcagggtggcgacaaggccgccgctgccgctccaacctcgcagaccgccaatctgctcagtgcactctcgcaactggatgtcacgccggagcaggccatcggcggtaccggcgcgatgctgggcctggcgaagaaccagctgagcagcaccgactactcgcaactgagcaaaagcgttccggggctggacaagctctcgggcggcaacgcgctgggcagcctgggcgccttgagcggcctgctggggcagagcggtggcaacaagaccgccggcctggagagtgcgctgggtaacgtgcagaacaccaatgacctgaacagcgcgttcagcgccctgggcatggacagcggcatgatcggccagttcgccccggtgatcctgcaatacctgggtcagcagggcgtgggcggttcgctgctcaacagcctgggcgggatctggggcgtcggcagcggcagttgatcaacggcgctcggcgcgcaaggcgtcgatgcgctggtccttttcggtccagagctggttgacccagttctggacagtctggcgaaacgccggatcgttttcgtaatccccctgccacaacgccgggtccagctcacggggctggatatcgacgatcacccgcggcacgttgccgctgatcaggtcccagaaaccgggaatcttctgctgcggatagaccaccgtcacatcgaggatggcgtcgagctgttcgcccatggccgccagcacgaaggccacgccgccggctttcggcttgagcagttgcttgaaaggggattgctgttgctcacgcttggccggcgtgaagcgggtgccttccaggtagttgaccaccgtgaccggctggcgcttgaacagctcgcaggcggccttggtgatttccaggtccttgccttgcagctccgggttcctggccaggaaggccttgctgtagcgcttcatgaaggggtaatccagggcccaccaggcgaggccgaggaagggcacccagatcagctcttttttcaggaagaacttgaagaagggggtacggcggttgagggtctggatcagcgccgggatgtcgacccaggactggtggttgctgatcaccaggtaagacgtgtcgccccgcagctcgtcaccgccgcggatatcccactgggtgggaatgcacagggcgaagatcagcttgtcgatttcggcccaggtttcggcaatccacatcaccgccttcgacgcatggtcgcgcaggcgccctggcaggaccagcttgagcagggcgaacaccatcagaggcccgaacaggaccagggtgttgagcaacagcagcagggtgacgaaacagccggtgagcaggcggcgcataaggaactcttgaaaacctttgggcgcgccatgataagcaccttcgccgggctggccaaatcctgatgtgctgacgaatgtttcacgtataccgggatatgctggcggtcaatttcgccgaccgtggcggctgcgggttttctcgcgggccgaaccaattgcccggccacggtctaaaatcctgctgcccactttccaaggaacctgctcacgtgaaatccgtccttgcactcctgtccctgctggcgctgccggtcatggccgccgagccgaccctctacgggcgctacgaatacattcaactgccggaaatcggcgaaaccctcaaggccaagatggacaccggcgccctgaccgcctcgctgtcggccaaggacatcgagaccttcacccgcgatggcgaggagtgggtgcgtttccgcctggcgaccaaggacgccgacggcaaggtctacgaacacaaggtggcgcggatcagcaagatcaagagccgcgccgatgaagacgaagacaaggaagaggcccaggtggccaagcgtccggtggtcgacctggaaatgtgcctgggcaacgtcaagcgcaccgtcgaggtcaacctgaccgaccgcagcagcttcaattatccgctgctgatcggcgccaaggccctgcgtgagttcggcgcggcggtgaacccggcccggcgttataccgcggacaagcccgactgctgattgacggcgcatgaggcatccggcaccgttctggcacttacctcccgtgcttggatgccatgcctcatatcctgattgtcgaagacgaagcggcgattgccgatacgctgatttttgccctgcagggtgaaggtttcagcaccacttggctgaatctcgggcaggcggcgctggactatcagcgccatacaccggcggacctgctgattctcgacatcggcctgccggacatcagcggcttcgaaacctgcaagcaactgcggcgcttcagcgaggtgccggtgatgttcctcagtgcccgggacggtgaaatcgaccgggtggtgggcctggaaatcggtgccgacgattacgtggtcaagcccttcagcccacgcgaggtcgccgcgagggtcaaggccatcctcaagcgcatggcgccgcgagcggtggtcgaggcgccggcctcgccgttccaggtcgataccgacaagttccagatcagctaccgcggccagctgctgagcctgacccgtcatgagttccgcctgctgcattgcctgctggagcaacccgagcgggtgttcagccgcgagcagttgctcgatgccctgggcgtggcggcggatgccggctacgagcgcagcatcgacagccatatcaagagcctgcgggccaagctgcgcctggtgacggccgatgccgagccgatccagacccatcgcggcctgggctacagctacagcccggggcacagctgatgccgttgggaatccggattttcctggtctacgtcctgttcgtcggcctgaccggctatttcgtgctcagcaccgtaatggaagaaatccgcccgggcgtgcgccagtccaccgaggaaaccctggtggacaccgccaacctgctggcggaaatcctgcgcgatgacttcaaggccggcaccctcagcgagaaccgttggccgcagttgctcaaggcctatggcgagcggcagccggcggcgaccatctggggtctgccgaagaaccaggtcaaccaccgcatctacgtcaccgacgcccagggcaaggtggtgctggactccagcggcctggcggtcggccaggactattcgcgctggaacgacgtgtacctgaccctgcgcggccaatacggcgcgcgctcctcgcgcagcgtggccgatgacccgaactcctcggtgatgcatgtcggcgcgccgattcgcgacaacggccggatcatcggcgtggtcaccgtggccaagcccaacagttccctgcaaccctatgtcgaccgcaccgagcgccgcctgctgtggtacggcgctggcctgatcggcctgggcctgctgttcggcgccttgctgtcctggtggctgagcgctgccctgcgccgcctgaccggttatgcccaggcggtcagcgaaggccgtcgcgccgagctgccgcactatcgcggcggcgaactggaacagctggccacggcggtggaggacatgcgcacccaactggagggcaaggcctatgtcgagcgttatgtgcacaccctgacccacgaactgaaaagcccgctggcagcgattcgcggggcggcggagctgctgcagagcgagatgcccggcgaacagcgcgcacgtttcgtcagcaacatcgacagcgaaagcgcgcgtatgcagcacttgatcgagcgtttgctgaacctggcgctggtcgagcagcgccatggcctggaagaacgggaagcggtgccgctggcggacctggcgaaccaggtactggacagccagaaggcacggatcgagggcaagggcctgcaggtcgagcagcgcatcgacccggggctgaaactgtcgggagaagcattcctgttgcgccaggccttgggcaacctgctggaaaacgccctggacttcacccccgccggtggcctgttgcgcttgagcgccagccgggctggcgaccagctgcggttgagcctgttcaaccaggccgagcccattccggactacgccctggcgcgcctgaccgaacgtttctactccctgccacggcccgacagcgggcgcaaaagcaccggcctggggctgaacttcgtcgaagaggtggtgcagctgcatggcggccagatgcggatcggcaacgtggccgggggcgttgaagtgaccttgcagttcccggcctgattgcctgcgtgtaccgttttgcggctgcttcgcagaccgatcgcagccttcggcagcggctacaaagtgggagtcgcacccaagccctgtagccgctggcgcagcctgcgatcgggcgcgaagcggccgccagatctgccagccaccccatctttgtaatgcccctgcgaaaggtcctccgcgatgggttctcgaaaaatcgctccaacctgtccaaagcgtatccagccgcaattgttgaccatggccagccgtccccccagtggtgacgactggctctatgaaatcaagttcgacgtacctcatgctcgcccggatcgagtcgggtgtcgccttgtacacgcgcaatggctacgactggacatgccgaatgccgcgactggctcgcgaccagcaacaactgttccttaatcccctgttgagggctgaggtagcctcaccgggatgttgggatgttgcccacatcataacgggtaagcagcgaacaacctcaatagttcagaattgtcctacagccacgattgcggaacgttgatagcctcgcgaggccctacagagggccatagctctccatggatcagtaacgcaaggatgatgaatgctctcttctgctcgcctgcgtgacaaacacgtctgcccacttcccggtcatggcaccacctcgattacctccgcttccggtgacataaacatcaacttcatgggtgccgcccgagtcggtgacatctgcggttgtggtgcggttattaccacggggtttccctcgatcatcttgaacgggcgcccaatggctcacctgggcagccctaccagtcacggcggaacgatcatctcgggcagccccgataccttcggcggtttccagttcggcggtgcagcaacccaggctatcgttgacttcgccaagctcggtgccgtgcgtccggacggctcagtgaacgatcaactgatgtctgagctgttggccgacccacaactggagcagcgcgccttgctcgccggcgctctggtgcaacctggcagttcgtccttaacaaccccgaaggagccgttgactcccgagctaatcgcagtcgccggcagccagcacgacacaagctcgggcaaccaaatgatgttcatcggccaagctgtgcgcgaactggccgagttcaagcgcagcaagcccgccctggcgcggacgctggtagtgttcaccccgtcatacagcgaagcaatgctcagtgcggcacgtgaatccgctgatgcctatgatgctggctttattggcgtaaccaacgttcaggaactgatcgactacatgaaccagggcaaggaccgcaagcaatcacccatccaacacctatcgctgttcagccacggcgtgccgcatcggatcgccttcggctatcagctcgccggcgacttccaaatgtccctggacgtactgagctacgagaagatttcaccttcggcgtttgccagttcggcgcagatcgacagctacgcctgtaggaccggcatgggcaatcggtcagacttccccgtcgaagatggtatccagttctttgcgcagactaatgagagcctggcgcagttgatggccaatcacctgcagatcaaggtgcatgcctttgttcgacgttcagattacaagaacacctgggggtcgttcgaggagcggcagttgggcaagctgtgtggcatcagcaataacgccgcacctggggaagagtggtgcaggaagtgggggacactgaaagatgaacgaaaggaaagccaggacatactgaagttcacctatcaaaccatgggggctatcaaccctgtaatttcaggcgacacgcccattggcataccaggaggtcattttgagtttctaccgaagtaagcccttctggatcgcaatagccattttctcaccgctactactggtcgcgagttactacgggttcaaattgatgacgagcatatacaagacggattttggcaacggtgtggtgatctatgccgacgattatgtaaaaaccggtcgctgggtgtttgactgtgaatactcacggttgatcagtcgagagccgctgcctgtaccgctatctgagttggagagcgctggaaaactcaccatcggcaacatgttctttttgaaggactcggacaaggagccagcgaaggaggcgctgagggccataacgggcatacgagattggtacaagagtctgcgttatctttactccagcttggatgaatatagtgatctcaacactcatgtttttgacttgctcgctaaacatgatggccggcagtgggccttgagagtgcgccagaacgtagattacagcggcaaatccagcttcaaagtaactgcggagccatacgatccagaaacttacgtggatcacgccaaggcactccaggccgccgccaagagctgtcctgttccacagtaaaggcaccagtcgggggccggctgactttccgtgaacaccaaagcacgcgggcctgtaagctattcaggaggcccgctgtccactctctatggggccaccgatagacgctcctgcaaagggcgaggagcaatctccacacagtctccacacagcccccataaaacccccacatgggctgcccagactctccctcattcgaacagggagagaacccatgaatcgcaatctgaccataaagctgggggctatcgcccttttgatcctggggctgctggtcccgctgttgatgatcgacgggctgatccaggagcgccaggaactgcgcgacggtgtgctgaccgatatcgcccgcagctccagctacagccagcaactgagcggcccgctgctggtggtgccttatcgcaaggtggtgcgcacctggaaaaccaacgagaagaccaacacgcgttaccaggaactgggagaagagcgcgggcagctgtatttcctgccggagcacttcgaactcgatggccaggttcggaccgaattacgcgcccggggcatctaccaggcccggctgttccatgccaacaaccgcatcagcggccagtttgcgctgcccgagcaattggggatcaaggaagacttcgtcgactacaaattcgagcagccgtttctcgccgtgggcatcagcgacattcgcggcatcgaacaggcgctggccctcgaactgaacgggcagaacctgcctttcgcgcccggcagccggattgactggctcggggagggcgtacacgtcaacctgccgctgctggacggcaagcgcagcaccgacctggacttcgccttcgatctgcaattgcaaggcaccggccagttgcaggtgctgccggtgggcaagaccagcaaggtgcgcctgcgtgccgactggcctcatccgagctttatcggcaactacctgccggcccagcgtgagatttccgacctgggcttcgccgccaactggcagacctcgttcttctccaccaacctggaaagcgcgttgatcgattgcctggccagcgggcagtgcaaggagttcaagaaccgctccttcggtgtgagtttcatcgacccggtggaccagtacctcaagagcgatcgggcgatcaaatacgcgctgctgttcatcgccctgacctttgccggcttcttcctcttcgaggtgctcaagagcctggcggtgcacccggtgcaatacgccttggtgggcgtggccctggcgttcttctatctgttgctgctgtcgctgtcggagcacatcggcttcgccctggcctacctgctgtcggccggggcctgtgtggcgctgatcggtttctacgtcagccatgtgttgcgcagcctgggtcacggcctgagtttcgccgccggcctggccgctttgtatggcctgttgtacggcttgctcagcgccgaggattacgcgctgctgatgggctcgttgctgctgttcggcctgctgggggtgttcatggtgctgacccgcaaactcgactggtacggcgtaggccaggccaaagcgaaccagccgctgacattcgaggcgcaggtggcccatgagtaggtcgttggggttgcgcgaggaccagcaggcggcgcaggccctgctgtcgtggatcgtcgggttgttgcccgaagcaccgtggggcggccatcgcgagcaagctcgctcctacatggaacagcgcagtacctgtaggagcgagcttgctcgcgatagggtcggcgcggccaccaccatgcttcaggtgggaggcttcaaaccggcggctgggtcgccagcatcgaagggcgtcgactgacctcggcgtaccaggccgccagttggggctgggtttcgcgccaccgcaggtcggggtggcggaaatcgaggtaacccagggcgcaggcaacgccgatggaagcgatgtcgaagtggctggccagttcggcgatcgcatcggcctcgagcacggccagggcgcggcggatcttgtcgcgctggccgtcgagccactgctcccagtgtttctcgggggcgcgcagggccagttcgtaacggatcagcaccgaggcatccaggatcccgtcggccagcgccgccagggtcaggcgccgccagcgggccgagccttcacgggggatcagcgggttgccgacatgctgctggtcgaggtaatcgaggatcacccggctgtcgtacagcacgttgccgtcggccaggcgcagggcgggaatcttgcccagcgggttgtcctggttgagggtggtgtccgggttcaccggggtcaactggctggcttgcagggccacgcggtccagctggccggtctcgtgcagcagcaccatgactttgcgcacataaggtgatgccgggttgtggaacagcgtcatgctgggggtggacatgaatattcctcgaaggtggaagtggagcgcaggctcgccgccccggggatcttaacgcagcctctggccccggccacaggggcggcatgcaggacagacaaggagtgatgaatgcgcaggtgttattttcgacacgggttgtacagcctggtcctgacgctgttgggcgcgctggcggtgtacctggccttgcagtacgagtttcgtcgccacggcgagggtgagccggagttgatcatggcgttcgcctacatggcctggtactgggcgctgccggcgctggccctgccggccctgggttgtgccctgttgagcctgcggggccccggtccggtgacccggccctggcgctggagcctggcggcgagctatgtaccgctgctggggttggcgctgttctgcgtattggtggccgccgaggcgcagcaggaaaaccgcgtattcatcccggtgctgccgatcggcctggggctggcgctgtacctgtggcgcggtttccccgtcgccggggtcaggccggtggcgggcggttgaacagaccccgcagggcgatcagggccggggcgcccaggccgagccagctcagggcgtcccagatgccgtcgccgagcagcgcggagaacagccccgcggcacagagcacggcaatgaacagcggcgcgccgaagaccttccagaagttcgattgccgcggcctcatggcgccaccgcggcgggttcgcccaatgccggccgggccgcacggcgccgcaccagccacaggtacaccccgctgcccaggacaatgatggtcagcacatccagggtcgcccagaggatcttcatcggcaggccgccgtagtcgccgaagtgcagcggttgcgacatacccatggcgtccatgtaccagggacgttcggccaccgcggtgacctccagggtgctggcgtcgatcagcaccggggtcagtaggtgcgaggtcaggtgggtgctgcctttcatgaacaccgcgtagtgatgctcgctggaaaaacgtgtgccggggaaggcgatgaagtccggctgcatgcccggcgccacctccttggcgatctccagcaggcggctggcgggggccagtcgggtcagtggcggggcatcgcggtaaggctcgatcatcgcgctgaggctgtcgttgcgccaggcggcgatcagcaggtcggcgcaggcgctgatcacgccggtgacgccgaccaccagggcccaggtcagggtcaccacgccgatcaggttatgcaggtccagccagcgcaggcgggtggatttgtcctggcgcaccgtggcgaactccagccggcgcatgaacggcaggtacagcaccacgccggagacgatcgccagcacgaacagcagccccatgaacgccagcaacagcttgcccggcaggccggcgaacaggtccacgtgcaggcgcagcatgaacatcatcagcccgccgttggccgagggtgtttccacggcttcgccggtacgcgcgtcgagcatgaaggtgtgggacgagttgggctcggtgccggcggtcctggccataatggtgagcacgccgttggggtcttcctcgtcccagccgaagtactgcatgacttcgcccggccgatgggcctcggcggcgcgcaccagctgctgcaggtccagctgcggggtgtcggcgggcatttcccgcaactgcggcgcgtcgcccagcaggtgatcgatctcatggtgaaagatcagcggcaggccggtcagggccagcatcagcaggaacaccgtgcagatcaggctggtccaggtgtggataaaggaccagcggcggatggttttgcttttcatttcttcgccttcagacacagcaaggccgtccttgcaggacggcccggtggttaactcagccgattaccactgataggtggcactggcgaccacgctacgctgatcgccgaaatagcagtaggaaccatcgcaggtggacaggtagtccttgtcgaacaggttggtggcgttgagcttcagcgacgcgcccttgaggctgttgtccaggcggcccaggtcgtaatgcacggcggcatcgaacaccgtgtaggcattggccttgcccagccaggtattggcctggtcgccgtaggtgttgccggtatagcgggcaccggcgccaatgccgaaaccgtcgagcacgccgctgtgccaggtgtagtcggtccacagggaggcttgctggttgggcatcagttgcaggcggttgcctttgtagatgcctttttgcacctcggacttggccagggtgtaggcggcgatgaccttgaggttgtcggtcacgtcggacacggcttccagttccaggcctttgaccttcacttcgccggtctggttggtgaccgactcgccaccggcaccgatgctggtcaccagcacgtttttctgggtcaagtcgtagaccgccgcactcagcagggtgttggagcccggcggctggtacttgatgcccagctcccattgcttgccctcggtgggtttatacgactcggtgggggagacgctggcgttgctggcgggctggaaggattcggcgtaggacaggtacggcaccaggcccgagtcgaacacatagctcaatgccgcgttgccactgaagttcttgctgcggtcggtgttggtcacgtcgttcttgttgaagtacgtggtgccctggtgcacccagtcttcacgaccgcccagggtcaggcgccatttgtccagggccatctggtcctgcacgtagaggccggtctgcacggttttctggttgtagtcgtagtaagcgctggagcgcgccgggcgcacgatcggctggccatagaccgggttgaagatgttggtggtcccgccgtcgccgtaaatcgacaggtaggaggtgtcggtccgttggtgatccaggccgatcagcacggtgtgggtgatgtcgccggtggcgaagtcggcctggaagttgttgtcgaccgcgaactggctgatgtcctcgtccacgttggtcgaggtacggctgatattgcctgccgcgtcagccggggagtaggcgtaggagcccacggtcagttgctggaaggacagctccgatttggtgtagcgcaggttctggcggaactgccagacatcgttgaaacggtgctcgaaggcataacccagggcgtagtaggtacggtcgtagaactcgtagtccgggtcgccgaggttcttgtgatgggagacgtcgcccagtggcgacttgatcttggtgccctggatcggcatgaactggctggtcgccccggtgtcgtcgcgggtgaactgcgagagcagggtcagcctggtatcggtgtcgatgttccaggtcaggctgggggcgatgttgtagcgcttgttgtcgatgtgatcgacctgcgttccggcatcccgcaccacgccgctgaggccgtagatgaactggccttcatcgtcgatcttgccggtgctggcgaagttgatctggcggtagttgtcgctgccgtactgcagctgaatggcattgctcgattctgcgctgggacgccggctgaccatgtccagcaggccgcccggcggggtctggccgtagaccgacgaggccgggccgcgcagcagggccaggcggtcgaggttccaggtttcggctttcgggttggcatacacgccgcggggcagtggcaggccgtcgaggaattgggtgggctcgaagccgcgcacgcgcatccagtcataacgggtgtcgctgccgtagctggcggaaacgatgccgggcatgtaacgcacggcatcgtccagattctgcacgttgcggtcttccatctgctggcgggtcgcgacggaaatcgaacgcggcgcttcgaccagcgaggtgtcggtcttggtgccggcggcggtgcgcgtggcgagataaccgtccaccggcccccaggcactctcataagcctgctggccggtgatgctggtttccggcagggccaccacaccgccgggaatcgccaccaggctgtaggtgccggcgctgctttgttccagttgcaggccggtgccgcgcagggcttcgcgcagggcgccggcggcgtcgaactggcccttgaccggggccgaggtcttgccggtggccaggctcgggttgaggctcagggccaggcccgcctggctggcgatctggttcagggtgctggccaggggcgcggccggcaggttgtaggcgcgcacgctggacgcctgttcggcggcgatcagcggggtgctggccagcgggacgcaaagggcaatcgccacggccaacaggctggggcgcaacagggtgtctagcgagcgggacatacggcggctcctggatggaaacatttctcaattgcctatgtgccggacgagattcaaaaagtgatagggcggactgaaaataatttcgatttgcgaaaacaagagggatatttcaggttggggcaggcggcgtcagttggaattttcgcgagcttgctcgcgataaaaatcgtgccgcctagggcttggccttgttctcggcccgcgccaccaacgtcacccaccagggcgtatgccgctcgatggccacgggcagcgtcggcagcagcgcgctcagggccaggtcggtgtcgtgcagcgggaagctgccggtgatgcgcaggtcggccacctcgtcggccacccccagatggccgcgacgatagcgccccagctcgctgaccaggtccgccaggcgcgcgttgtccaccaccagcatgccgcgggtccaggcgtcggcgccagggttcagggccagtagcgggccgaggccgtcgcggcgtatcagcacctgctggccttccttgaggatctgttcgtcctggctggattccggccgcgcggccacggccgattgcagcacgctcaggcgcgtgccttgttcctcgcgcttgaccaggaaccgcgtgcccagcgcgcgcatatggccttcgcgggtttcgacgataaaggggcgggcgtcgttgtggccggtctcgaccaggatctcgccttcctgcaacacgatgcgtcgctgtttttcgtcgaaacgcacatccacggcgctgtgggtattgaggttgatcacggtgccgtcggccaggcgcagggtgcgctgctcgccggtggcggtgcgctggtcggcgagccagtaatccagctggccgtaacgttcgccggcgaacagggccaggcccagcagcagggcgacgctggccagcccactgccgagcttgcgcacacgacggcggaggccgtcccgcgattgcagcagggcgctgcgggccgggccgctggcgacgctgaaacgctggtcgagcatgcccagctggcgccaggcgcgggcgtgttcttcatcggcggcgtgccatttggcgaattcttcgcgggccatcggattgctctcgccggaatccagcgacaactgccaggcaatcgccgcgtccagcacccgggcggacaccggtttggcgttgagcgggctcatgccggctcaccgtacagggcgacgtagcactggcgaatgccctgggccaggtactgcctgacccgcggcacggacaccccgaggcgttcggcgatttcggcgtggccgaggccgtcgaggcggttatagaggaaggcggcgcgggccttgctcgacagcttgcccagcaggcggtcgatggccttgaggtcttcgaggatcgattgctgttcttccggtgagggttgttcctcttccgggatcagcatcagttcggtgaggtaggcctgctccagcgcggcgcggcggaagtagtcgaacagcaggcccttggcgatggccaccaggaacgcccgcggctcgcgcggggctttcagctcgtcgcggcccagcaggcggacgaaggtgtcctggctcaggtcctcggcccgttgtgggcaggccacgttgcgccgcagccaggccagcagccagccgcgatggtcgcgatacaacgcaccaacgaggtcactgtgggggctttgggctgacggcacctgggtatcccaatcgagaagttgaaactaacgagaattattcgcgattgtggcagggcgcaaagagccgcgcaatgggcgctggtcggcggggcgcagccaatgtttgcgggccgatacctgtagccgctgccgagcaacgcgaggctgcgaccggcaacgcagttgccgcaaagcctgggcttgcagtgtgtctggcagagcgcgttaccccggccggcgaccgctatgcgctcgatcgcagcctcgcagggctcggcagcggctacagggtcagaaggagtggctctgctgccggcgcttccattggctgagccgctgttgcaggttcagcgggctgtggatctgctgctggcgggcgcggctgaacaggatcagcgccagctcggcggtggccagggcgtcggcggcggcatggtggcgttcgccggcctgcagcttgaagtagcccatccagtcatccagcccggcttcgcggatatgcgcctgggggcagagcagcggggccatgtcggcgacgtcgaggaacgggtgctgcaggcgataacccaggctgtccttcagcgcccggccgagcatgtgctggtcgaatggcgcatggaaggccagcagcgggctgtcgccgacgaacgccatgaaatccagcaaggcttccaccgggtcgctgccggcggcgatcgcgctagggccgagaccgtgaatcagcacgctagggctgagcttgtgatcggtacgttgcaaggtgcgctcgaactgctggcccaaatcgatggcgccgtcttctatcactaccgcgccaatggacagcacctggtcgcgattgaggttgagcccgctggtttccaggtccagcaccacccagcgctgttcgcgcaggctgcattcgcccaacaccggggcgacgggcaggcgctcgcggcgttgttgctgctcggcgctgagtgccgcgctggccgggcgcaaccaggcgaacaggctcatagctggtacctcagcgccaggctgctttgcaggcgctgggcctggcgcagcgactcgcgcaggatgcgccggtccaggtggttgaggctgtccgggtcgacgcggttggagtagggcaggttctgccgggtctgcaattggtgctgttgcatgcgggtttgctgaatgaagtgataagcctcttcatacgcggcgccgtcgagggtttcgatgacttccctggccaccagctggcgcaggcgctccagggtgttgttggcatcgatgccattggccagggccagcaggcgcgcgccgtcgacgaagggggtgaggccctggaccttgaggtcgagggtggctttttcgccatttttcctggccaggacgaactcgcgaaaacgccccaccggcgggcgctggcgcagtgcgttctcggccatcatgcgctggaacaggcggttgtcgccgacctggtcgaggataccgcggcgcagttgcgcacagccctgctcgtcgccccagaccacccgcaggtcgaaatagatgctcgaacccagcaggttctccggcgtggcctcgcgaatgaaggcggcgaagcgccgtgtccactcggcgcgggacaggcacagctcggggttgccggccatgatgttgcccttgcacagggtgaagccgcagagcgccaggctctggttgatctgttgcgccaggggcagcagcttgccgcgaatctctgccgcatgagcggcgtcgcgcgcttcgaacaggatgccgttgtcctggtcggtgtgcagagtctgctcgcgccggccttcgctgccgaaacacagccagctgaacggcacgcccgggtcgcccttgtcggccagggtcagttcgatgacccggcacacggtgtggtcgttgagcagggtgatgatgtgggtgatctgggtcgaggacgcgccgtgggcgagcatgcgctccaccagctggccgatctcgccgcgaatcgccaccaggttgtcgatccgcggcgcgttgcggatggtccgcgccaggtgcaccaggtcgacccgttgcagggaaaacaggtcgcgctcggaaaccacgccgcacaggcgctgctctttgaccaggcagacgtgggcgatgtgccgttcggtcatggcgatggcggcgtcgaaggcgctgtggtccggcgagagggcgaacggtgcttgggtcatgtgccgttcgataccctggttgaagtcgctggtgccgtcggccaccacctggcgcaggtcgcgcagggtgaagatgccgagcggcgccttgtgttcatctacgaccactatgctgccgacctgctgtttgtgcatcaggctcacggcttcgcgcagtggggtggacgggctgcaggtcactgggtggcgcatcgccagttcgcccagccgggtgttgagggagtattgggtgccaagggtttccacggctttttgctggacctgctggttgacctggtccagcaggctgctgacgccgcgcagggcgaaatcgcgaaacaccgcgcaaagagcgaacagcttgatgaaggctggcttgttcagttgcaggcagaaggtgtcctcggccgccaggtgttcggtgcgggtggcgcgctcgcccagcagcgcggcgagggggaaacactcgcctgccgtgatctcgaaagtggtttcggtaccgcctttgagggtgtgctggcgctcgccgaccacccggccctgcttgacgatatagaagtgttcgaccggtccgtcggcgggtttgatgatgctttcgccggggccgtagaaacgcagttggcattgctcgaccagatacgccaggtgagcgttttccatctgattgaagggggggaaccgctggagaaactgcatcgtgccgtggatgttctgcaacaccgcggttttccctgcctgggtgaaggcatccgctttactcataaccattaccgcagtctttttggatttgtcgtggtcgggtcttcggtcatggtcggtcccacgctgccgggtgcccattggacgtaagtctaggtagcggctctgcacctgttaattcgcttcacgcaggtgtcaaaactgtgaaaaaagtacttatccggcctcttggaaaaaaatccgacgaagtgcacattggaggcctgcttagcgatgtctgaccactgtgctaggggatcgatttgaatatgtagagaaagccatgtccgaccacgatattttgagtgatgccgagcgcgaggcgttgaacgccgtgatgctcgagcccgatctgccgccccagcgcgtgttgatcgctgatgatgacaaggatgcccgtgagttgctgtcggagattctcggactggatggcattcgctgcatgaccgcggccagtggcaaggcagcactggaactgttgaactcgaacaaatcgatcggactgctgatcaccgacctgcgcatggccccctgcaacggcctggacctgatacgccaggtgcgcgaatcggagcgggcggcgttgccgatcattatcatttccggggatgccgatgtgcgcgacgccatcgcggccatgcacctgagcgtggtggacttcctgctcaagccgattgacaccggcaagctgctggcgctggtcaagcatgagctgggagtggtgcgctaggaacagggtgtccccgtaggagcgagcttgctcgcgataagattccccggcaaaaacacaaaagccctgatcttgcgaccagggctttttcttttaccgcgtcaacgcaggatcacaggccgttgcgggctttgaactcgcgacgacgacggtgcagcaccggctcggtgtagccgttgggctgcttggtgccttcgatcaccagttcgaccgccgcctggaaggcgatgttgctgtcgaagttcggtgccagcggacggtacagggtgtcgccggcgttctgccggtccaccacgggcgccatgcgcttgaggctttccatgacctgggcttgggtgacgacgccatggcgcagccagttggcgatgtgctggctggaaatacgcagggtggcgcggtcttccatcaggccgacatcgttgatgtccggcaccttggaacagccgacgccctggtcgatccagcgcaccacgtaaccgagaatgccctgggcgttgttgtccagttcgttcttgatctcttcggccgaccagttggtgttgctggccagcgggatggtcaggatgtcgtccaccgaggcgcgggcacgcttggccagctcggcctggcgggcgaacacgtcgaccttgtggtagtgcagggcgtgcagggccgcggcggtgggcgacggtacccaggcggtgttggcgccggccagcgggtgggcgattttctgttcgagcatggcggccatcaggtccggcatggcccacatgcctttaccgatctgcgcgcgaccttgcaggccggtgctcaggccgatatcgacgttccagttctcgtaggcgccgatccacttggcggccttcatctcggccttgcgcaccacggcgccggcttccatggaggtgtggatttcgtcgccggtacggtcgaggaagccggtgttgatgaacactacgcgctcgctggcggccttgatgcaggccttgaggttgaccgtggtgcggcgctcctcgtccatgatcccgactttcagggtgttgcgcggcagttccagcacgtcttcgatgcgcccgaacaactcgttggtgaaggcggcttcttccggaccgtgcatcttcggtttcacgatgtacaccgagccggtgcggctgttggtgcgcgaggtgttgccgttgaggttgtggatcgccgccaggctggtgaccaggccgtcgaggatgccttccggcacttcgttgccttgactgtcgaggatcgcgtcgatggtcatcaggtgacccacgttgcgcacgaacagcagcgaacggccgtgcagcttcacactgccgccgttgggcgcggtgtattcgcggtcggcgttcatggtgcgggtgaaagtcttgccgcccttggccacttcttcggccaggtcgcccttcatcaggccgagccagttgcggtagatcaccaccttgtcatcggcgtcgacggcggcgaccgagtcttcgcagtccatgatggtggtcagggcggcttccatcagcacgtccttgacgccggcggcgtcggtctggccgaccgggctgctggcgtcgatctggatctcgaaatgcaggccgttgtgtttcagcagcaccgcggtcggggccgcggcgtcgccgtggtagccgatcagttgggcgtcgtcgcgcaggccgctgttgctgccacccttgagggcgaccaccagcttgccatcgacgatcttgtagccggtggagtcgacatgggagccggcggccaatggcgcggcctcgtcgaggaaggcgcgggcgaaggcgatgactttgtcgccgcgcaccttgttgtagcctttgcctttttccgcgccgtcggcttcgctgatggcgtcggtgccatagagcgcgtcgtacagcgagccccagcgggcgttggaggcgttgagggcgaagcgggcattcatcaccgggaccaccagctgcggaccggccatgcgggcgatctcgtcatcgacgttttgcgtcgtggcctggaagtccgccgcttctggcagtagataaccgatgtcttgcaggaaggctttgtaggccacggcgtcgtgggcctggccggcacgagattggtgccaggcatcgatacgcgcctggaaatcgtcgcgtttggcgagtagggctttgttcttcggcgccaggtcgtggatgaccttgtcggcaccggcccagaacgtgtcggcggtgaggccggtaccgggaatggcttcgttgttcacgaagtcgaacaggactttggcgacctgcaggccaccgacttgaacgtgttcagtcattgcttgcctcactctgctcagctatttcgcttttcagctcttcaaattaacaatgaagcctctggccatttaaaccacaaacccctctaccagtacatgccatcgcgggcggctgggatggttccaatcaacggctcggagccttgctgacagggctttcagggttgcgactgcgccttggcagacatcgattcaacgttatgtagtgcgcgctgcggcatactacatgatgaattgcggttgtgaaaattagactaaatacgtcgttccgcgactcaagttcgcggcatggtcacgctggggaacaggatgttctcaaaaaacttgcggattgttccatagaattcaaaaaacatgtacacgatttgtctcaagcccccttttttccttgtaggcgcgaagcttgttcgcgatggcgtcctgacagtcccaacgatgccggccgggtgattcttgtcgcgagcaggcgtcgctcctgctggtccgcggcgaccctgcggcttgcctatacttgaccttctacaacaaacgtcctgacagagggttgcgccatggaccacctcgtactcaccgtattcgccccggacaagcccggacaggtcgagcgcatcgcccaatgcatcgccgcgcacggcggcaactggctggagagccgcatgtcgcgcatggccgggcagttcgccggcatcctgcgggtcggcgtgccggcggaagcctatgacgagttggtggacgccctgcaaggcctggcggcccagggcattcgggtgctgatcgccgaaagcggtatcgaacaatcctgcacctggaagccgatcgccatggaactggtgggcaacgaccggccgggcatcgtgcgcgacatcacccgtctgttgagcgagcagggggtgaacctggagcggctggtgaccgaagtgcgcccggcgcccatgagcagcgagccgctgttccacgccgaagcgatcctggcggtgccgctgaccttgtccctcgacgttttgcagtcgcgcctggaaaccctggcggatgacctgatggtggagttggtgctgcgcagcgaggtgtgaaccgaaggggcaggttatccagttttagcgtgcatgcgcctgtggataacctgtagagacccagcgccagcccaagccggccaaggctttgcggaatctgatcaaaaaaccggcagtttcaagggcttgtgcacaaacggcggggatcacgctgtgggtaaccttgggaaggatagatgcaggccacgccaaccgtggcctgcagagctttgtacgtttattgatcagctgcgtttgcgcaggctcaaccaggcatccacgctgtacaccgccaggccggcccagataaacatgaacgccaccagggtgctcgacgacaggtgctcgtcgaacagcagtattgcctgcagcagcaccagagtcggcgccaggtactgcaaaaagcccagggtggtgtagggcaggtgacgggcggcggcgttgaagcacaccagcggcaccagggtgaccgggcccgccgccaccagccaccaggcctcggagctggtccagaaggccgcctgggcactggtggcggtggggttgaacaagagccaggcgagggcgatcggtaccagcatccaggtttccaccaccagccccggtagcgccttgaccggtgcctgcttgcggatcagcccgtagaaaccgaaggtcagcgccagcaccagggaaacccagggcaggctgccgacctgccatacctgctgcgccacgcccaccgccgccaggcccaccgcgagccactgcatgcgccgcagccgctcaccgaggatcagcatgcccagcagcacgttcaccagcgggttgatgtagtaacccaggctggcttcgagcatgcgcccgttgttcaccgaccagacataggtcagccagttggccgcgatcagggtgccgctcagggccaggatcgccaggcgcctggggttgtcccgcagctcgcgccaccagccgggatgcttccagaccatcagcagcagcgcgccgaacagcgcggaccagagcacccggtggatgatgatttccacggcgggcacgttggcgatggctttgaagtagatcgggaacaggccccagatgatgtaggcactcaggcccaggatgtacccgcgacgcgggttggcggcttgcatgcagaatccttgcttaggcagctaacaaagaggggattgtaaggaggtttgtcaggccgtgtctttgtcggcgtcatcctggttgccggcttttgtgatcaatccgggggtctgtaggagcgaggcttggggtcagaacagcttcaacggttcttcgttgagcgccgaaagctgttcgcgcaacgccagcacctggtcgccccaataacgctcgctgccgaaccaggggaaactgcgtgggaaggccgggtcgtcccagcgccgggccagccaggcgctgtagtgcatcaggcgcagggcgcgcagcggttcgatcagcgccagttcgcgcgggtcgaagtcgtggaattcgctgtagccatccatcagttccgacagctgccccaggcattcctggcgatcgccggcgagcatcatccacaggtcctgcaccgccgggcccatgcggcagtcgtcgaggtcgacgatatggaacacctcgtcgcggcacatcatgttgccgggatggcagtcgccgtgcatgcggatgttctggtgcggcgtggcctggtagacctcttccacccgcttgagcaggtcgcgggccaccgactcgtaggccggcagcaggctcttgggcacgaaatcgccttccagcagggtggtcagcgaatcatggccgaagttcttcactcccagcgcttcgcgatgctcgaacgggcgggtggcgccgaccgcatgcaggcggccgagcaattgccccaggcgatacagctggtcgaggttgccgggttccggcgcccggccgccacggcgtgggaacagggtaaagcggaagccttgatgttcgaacaggctttcgccctggtgaatcagcggcgccaccaccggcacttcgcactcagcgagttcgaaggtgaagcggtgctcttcgaggatcgcctcgttggtccagcgctgcgggcggtagaacttggcgatcagcggctcgctgtcttcgatgccgacctggtagacacggttttcgtaactgttgagtgccaggacacgggcgtcgctgagaaaaccgatgctttcgacggcatcgaggactagatcaggggtaagggtttcgaacgggtgagacatgctgactcctgcgcgcagcaggctgctgcgtccggccaagcatggtagcgcacgaaggatgacaggtggtgactgtgagggcgctatcgcgagcaagccttgcccctacagacatgtgtaggggcaaggcttgctcgcgaagcagtggatcaggcgccgacgataccgccgtcttcccgggtgatcaccatcaccgaggagcgcggcttgccgttgggcaggtgctcggggaaggtcgaaccgccgttctcgcccgggtgctggatgcccacgaacaggctccgttgatccggcgagaaggtgatgccagtgacttcgcagcccaccggcccgaccatgaaacgacggatttcaccggtgtccgggtcggcgcagagcatctggttgttgcccatgccggcgaagtcgccggtgttgctggagtcgccgtcggtgaggatccacaaccggccggccttgtcgaaacccaggccgtcggggctgttgaacatgttctgcgcagtgatgttcgacgagccgcctttgggctggccggcatgcacggccgggttgccggcgaccacgaacaggtcccaggtgaagtccatcgagccgtggtcgccacgggcggtctgccagcgcaggatctgcccgtagacgtttttctcccgcgggttcgggccgcccacaggctggccgtcttcgccacgtttggagttgttggtcagggtgcagtagacctggccgtccttcgggctgaccacgatccattccggacggtccatgcgcgtggccttgaccacactggccgcgaggcgggcgtggatcagcacttcggcctggtcggcgaaaccgctgctggcgtcgatgccgttcttgccatggctcagctcgacccatttgccctggcctttcgggtggtccgggttgccgtcgccattgtcgaagatcgccacgtacagggtgccgtggtccagcaggtcgcggttggccttggggttgcggtggttgatgcggtcgcggctgacgaacttgtagatgaactcgccacgctcgtcgtcgcccatgtagaccacggcgcgtccgtcgcgggtttcggccagggcggcgttttcatgcttgaagcggcccagggcggtgcgcttgatcggcttggactgcgggtcgaacgggtcgatctccacgacccagccgtgacggttgagctcgttggggttcttcgccaggtcgaagcgcgggtcgaactgatgccagttgatgtcgcggctgctcgccgaggcgccatagcgtttctgcgcggcatcgaacgtctgctgggcgttgctgctgccgaagcagtcggtgaagttctcttcacaggtcaggtaggtgccccatggcgtcttgccgttggcgcagttctggaaggtgccgaggactttgcggccgctcttgtcggcgctggttttcatcagcgcgtggccggcggccgggccgctcaggcgaatcggcgcgttgccatggatacgccggttgtagcgcgagccctggacgaactgccattggccgctgcggcgctgcacttcgatcaccgacacgccttcgctggccagggccttgcgcacgtcttccgccgactgcggcatgccgccgtggggatagaggtagcggtagttggtgtattcgttgttgatcgccatcagtgcgcgattcttgtcgtccgggaaggcgaacaggctcatgccgtcgttgttgtcaccgaactggacctcctgggccgcggcggtgccattgccgctcgggtcgaacgccgggccgttcttctgcaggggctggccccagctgatcagcaccgaagacttgtagcctggcggcagggtgatggtgtcgctggtggcggcggcaatgccttcaaagcccagcagcttgctggaaccggcgctgacgctggcggccagcacgctgcggctcagcaggttgccaccgaggaacatggccgcgccgcacagggccccggcgctgatgaaaccacggcggctgaggccgaccatcttttcgaggtcggtaggttggtcttcttctaataggctcatcacaggctcctgcgggattttgcagccaccttaatcagcgtcgatgacgaacatattgcagtgacgcaagcattccgccgtttgtgtagccgctgccgaaggctgcgatcgagccgaaggctcgcagggagcttgagtcaatcaaggtcctgcgaccttatcgcagcctgcggcagcggctacagagccgtgataagtctggttacagcggcgtgccgagcagcacgttggatggcgagaactgcacccgtaccggctggccggcgctcaagccaaggtgtcgcaggtgcagcggttcggccagggcacagagcgtctggccgctgggcagggcgattctgatttcgctggggccgtcttcggcgtcgaggatcgcttccagggtacccagcagacaattgtgtccgggtgttgcgggttgatcgatggccagcaattccagccagccggccttgatcaacgccacgacgcctgtgcccggctccaattccagatgcagggtgctgtcatgggtgatctgcgcctggatcgccaggtcttctgcgagcgccagtcgtatcagatcgttgcgcccctgcgcttcgatcgccagcaccgtgccgtgcaactggttgcgggcgctggtgcggagcatcaggcgccccagcagatcgaggtcggcggcgtcttcggcggcttccagcacttgggcttgcaaggcctgcaagcgctggtagaggcgcagcacccgttcgccttcgacggagagcctggcgccaccgccgcctttgccgccgacactgcgttcgaccaggggcttttgcgccaggttgttcaactcgtcgatggcgtcccaggccgccttgtaactcaggccggcgcttttcgcggcacgggtgatcgagccctgttcggcgatgtgctgcagcagggcaatgcgctgcgggcgacgggcgatgtgctgggtcaacaaggtgggcaagggcatggctgaacgctttgaacgctgggaatggaaagggagtttgcggcttgaggggcgagagtcaagttcagtcgggctcgccgggttttggcgtgcgtgccaggcaatagacgtctacccgccgcgccccggccttgagcagcagccgcgccagggcgtgggcggtcgcgccggtggtgagcacatcgtccaccagcgccaggtgccggccatggaccgccgcctctggcagcagggcgaaggcgtggtgcaggttgcggtgccgcgccctggcatccaggccctgctgcgatggcgtgtcctgggtgcgctgcaacgaggtttcgtcacaggggatttgcaggatctcgcccagccagcgcgcgagcatcgccgcctggttatagccgcgctggcgcaggcgcttgcgggccaggggcaccggcagcagggcgtcgggttgcgccaggtcctcggcaaagcgatgttgcagcgattgcgcgagaagttcggccaaaagacggccaaagggccatttgccgttgtgcttgaaacggctgaccaggctgtcgaccggaaagccataacgccagggcgccaccacctgggcgaaggcgggcggtcgcttgaggcattggccgcaggtcaggccggccgcgggcaggggcagggcgcagacctggcaatgatcgccgagccacggcagctcggtttcgcaggcggtgcaaatggcttggggcgtgtcggtcggttcgtcgcagagtaaacaggtttgtttgttttttaaccagatgtaaaccggtccttggtaatgtggttgacactgcatggcgcttccttaaatatgcccaacatccgtgtcgcggctgtgggtattgccttcccgcagccgcttgccaagcataatcaaggaatcgcccatgagcgccagcaccaccgccaatctgcgtcatgactggacttcggctgaagtcaaagccctcttcgtccagccgttcaatgacttgctgttccaggcgcagacggtgcaccgcgcgcatttcgacgctaaccgcgtccaggtttccaccctgttgtcgatcaagaccggcgcctgcccggaagattgcaaatattgtccgcagtccggtcactacaacaccggcctggaaaaagaaaagctgatggaagtgcaaaaggtcctcgaagaggccgcgcgcgccaaggccataggttcgacccgtttctgcatgggcgcggcctggaaacacccgtcggccaaagacatgccgtacgtgctggaaatggtcaagggcgtgaaggccatgggcctggaaacctgcatgaccctcggtcgcctggaccaggaccagaccgaagcgctggcgaaggccggcctggactactacaaccacaacctcgatacctcgccggagttctacggcagcatcatcaccacccgcacctacagcgagcgcctgcagaccctggcctacgtgcgcgatgccgggatgaagatctgctccggcggcatcctcggcatgggcgaatccctcgatgaccgcgccggcctgctgatccaactggccaacctgccggagcacccggagtcggtgccgatcaacatgctggtgaaagtggccggcacgcctctggaaaactccgaggacgtcgacccgttcgacttcatccgcatgctcgccgtggcccgtatcctgatgccgaaatcccatgtgcgcctgtccgccggccgcgaagcgatgaacgagcagatgcaggccctggcgttcttcgccggcgccaactcgattttctacggcgagaaactgctgaccactgccaacccgcaggccgacaaggacatgcaactgttcgcgcgcctgggcatccagccggaagcccgcgaagagcacgccgacgaggtgcaccaggccgccatcgagcaggcgctggtggagcagaagagcagcgagcagttctacaacgccgcggtttaagcatctctctgtgtagccgctgccgcaggctgcgatagtccgggccatgctggtcgcaggacttcgacggactcaaggtcctcgcgccccttcggggcgatcgcagcctgcggcagcggctacggcaatcatcgtccgatcatcgaggcctgcatgtctttcgatctccgcgcgcgtctcgctgcccgtcgtgccgaaaatctctatcgtcagcgcccactgctggaaagcccgcaagggccgcaagtggtggtcgacggccagccgttgctggcgttctgcaacaacgattacctgggcctggccaatcacccgcaagtgatcgaagcctggcgcgccggtgcgtcccgctggggcgtgggcggtggcgcctcgcacctggtgattggccacagcacgccccaccaccagttggaagaagccctggccgagttcaccggccgcccgcgggcattgctgttcaccaccggttacatggccaatctcggcgcggtcaccgcgctggtggggcagggcgacacggtgctggaagaccgcctcaaccacgcgtcattgctggatgccggcctgctctctggcgcgcgcttcaaccgttacctgcacaacgatgccgagagcctggccaagcgcctggagaaagccaccggcaataccctggtggtcaccgatggtgtgttcagcatggacggcgacctggccgacctgccggcgctggctcgcgaaacccgggccaggggcgcctggctgatggtcgacgacgcccatgggttcgggccgctgggggccaatggcgcagggatcgtcgagcacttcggcttgagccaggaagaggtgccggtcctggtgggcaccctcggcaaggcgttcggcaccgccggcgcctttgtcgccggcagcgaggaactgatcgaaagcctgatccagttcgcccgtccctacatctataccaccagccagccgccggccctggcctgcgccaccctgaaaagcctggagttgctgcgcagcgagcactggcggcgtgagcacctgaataccctgatccgccagttccgccagggcgccgagcagatcgggctgaccctgatggacagcttcacgccgatccagccgatcctgatcggcgacagcgcacgggcgattcgcctgtcgcagatgttgcgcgagcgtggcctgatggtcaccgcgattcgtccgcctaccgtgcccgcggggagcgcccgcctgcgggtgaccctgtccgccgcccacagtgaagctcaggtccagctattgttgaatgcactggcggattgttttagcgaaccgggaccggagccaagccatgcgtgatcgactgattctgctgcccggttggggtctcggcgtatcgccgctcgaacccttggcggcggcgctgcaggggctcgacgaacacctgcgggtcgagatcgagccgttgccggagctggagtccagcgacctgaatgagtggctcgacgaactggatgccagcgtgccggacaatgcctggctcggtggctggtcgctgggcggcatgctggcttccgagctggcggcgcgtcgtggcgagcgctgctgcggtctgctgacgttggccagcaaccccagtttcgtggcgcatgccgaatgggcaagcgcaatgccgggggagaccttcgacgggtttctggccggctgtaacgccgacccacgcaccaccctcaagcgcttcagcctgttgtgtgcccagggcgccgaagatcctcgcggcctgtcgcgcttgctgtcgggcggtgcgccgcatacctcgggcacggtgttgatggccggcctggagttgctggcgcagctggacacccgccatgccttgcaggcgtttcgtggaccgcagttgcatctgttcgccgggcttgatggcctggtgccggccgaagccgcaggtgaattgctggcgttgttgcccgatgttgaagttggcctgattgagcaggccagccacgcgtttcttctggaggatccccacggtgtggcgggggcgatccaggcttttttgcatgagtccggtgatgactgatctgtcccttcccaagccccccggcagcttgcccgacaagcgccaggtggcggcttccttttcccgcgcggcgtccagttatgacagcgtggcgcaactgcagcgcgacgtcggtaacgagttgctgggccgcctgccgcaagaccgcgagcctggtcgctggctggacatgggctgcggcaccggttatttcagccgcctgttgggcgagcgtttccaggccagcgaagggctggcgctggacatcgccgaaggcatgctcgagcacgcccggccgttgggcggggcgcggtatttcattgccggcgatgccgagcgtttgccgttgcaagggcagagttgcgaactgattttctccagcctggcggtgcagtggtgcgcggatttccgttcggttctcagcgaggcgcatcgggtgctgaagccgggcggcgtgctggcctttgccagcctgtgcgtcggtacgctgtacgaattgcgcgacagttggcgtcaggtcgacggcatggtgcatgtcaatcgctttcgtgagttcagcacgtatcaacagctgtgtgcggcgagcggcttgcgggtgctgagcctggaaacctgtcctcatgtgctgcactacccggatgtgcgcagtctgacccatgagttgaaggccctgggggcgcacaacctcaaccctggacggcccggcgggctgacagggcgggcgcggatcaagggcctgatcgacgcctacgaacagttccgtcaagcgcagggattgcccgcgacctaccaggtggtctacgccgtattggagaagccgctatgagccgagcctatttcgttaccggaacagacactgatgttggcaagaccaccgtcgccgctggcttgctgcatgccgcgcgactctcggggctgagcaccgcggccgggaagccggtggcttcgggctgtgagctgacccccaaggggttgcgtaacgccgatgccttggctctgttggctgaatgttcattgccgctgacctacgacgaggtcaacccactggcctttgaaccagccatcgctccccatctggcagcccgcgaggctggcgtggcgttgacggtgcaggccttgctggcgcccatgcgccaggtgctggccaagggcgccgatttcaccctgatcgaaggggccggcggctggcgtgtgccgctggccgatcaggacaacctgtccgacctggccatggccctggatctgccggtgatcctggtggtgggcgtgcgtctgggctgtatcaaccatgcgctgctgacggccgaggcgattgcccaggacggattacagctggccggttgggtggccaatatcatcgagccgaagacttcgcggcttgaggagaacctcgccacgctagcggagcgcctgcccgcaccttgtctggggcgggtcccgagattgaaggcgatcagcgccgaagcggtggccgagtatctgcaactggacctgcttgactagattttgcctatggtaaggcactgtgccattagtgtttttgacgggtctttttctgacgcgtctggttcaatagccgctgttcattccttgcagggtcgaattctcccatggaaatttccgggaataccgctttctacgccggcctgagtaccgtgcagaccgggcagaatcgtgtcgatcaggccgccagtcagatcgccaatacgaccatcgaacgctctgtcgccagccaatcctctgaggtacaagtcgagcgcctgcgatccgtcgatcgcagccagcaatcggacctggccagcaatatggtcgagatggccatgggcaaggttcaggcggagctgggtgtgaaagtcgccaaggccgccgatgaagtgctcggtacgctgatcgacacctacgcttgaccctccttcggtatccctgcccatttttgcgggcagggtgacccgcgcaagaacgccctgcacagccccatcttccgtcttgctggcctgccagctcctacactctattcagcttccgaatatttcacggcattcgctgtgggcctttgcgtgcaaggcctgcagaggatcgatgacgaacggtgtttgcgtggcgcttgacaaggtttgggcgtaaacgtatgtttcaaacagctgtttgaccgccacaataaatcaacgcggtcgttcattcccggttacatcagcagaggtttatcgctatgcctgactacaaggcccccttgcgtgatattcgcttcgttcgtgacgaactgctcggctatgaagcgcactatcagagcctgccggcttgccaggacgctactccagacatggttgacgccatcctcgaggaaggcgcgaagttttgtgagcaggtactggcccctctgaaccgtgtgggtgacctggaaggctgcacctggagcgagtctggcgttaagaccccgacaggcttcaaagaggcctacaagcaatttgtcgaaggcggctggccaagcctggctcacgatgtcgagcatggcggtcaaggcctgccggagtccctgggcctggccgtcagcgaaatggtcggcgaagccaactggtcgtggggcatgtacccaggcctgtcccatggcgcgatgaacaccatctccgaacacggcacgcctgagcagcaagaggcttacctgaccaagctggtatccggcgagtggaccggcaccatgtgcctgaccgaaccgcactgcggcaccgacctgggcatgctgcgcaccaaggccgaacctcaggccgacggttcctacaaagtcaccggcaccaagatcttcatctcggccggtgaacacgacatggccgacaacatcgtccatatcgttctggcccgcctgccggatgcaccggctggcaccaaaggcatctcgctgttcatcgtgccaaagttcctgccgaacgccgatggcactgttggccagcgcaatgcggtgagctgcggttccctggaacacaagatggggatccacggtaacgccacttgcgtgatgaacttcgacgcggccaccggtttcctgatcggcccggcgaacaaaggcctgaactgcatgttcaccttcatgaacaccgctcgcctgggtaccgcgctgcaaggcctggcccacgccgagatcggtttccagggcggcctgaaatacgctcgcgatcgtctgcaaatgcgttccctgactggcccgaaagcgccggacaaggccgccgacccgatcatcgtgcaccctgacgtacgtcgcatgctgttgaccatgaaggctttcgccgaaggcaaccgggccatggtctacttcaccgccaagcaggtcgacatcgtcaagtacggcgtggacgaagaagagaagaagaaagccgacgcactgctggccttcatgactccgatcgccaaggccttcatgaccgaagtcggtttcgaatccgccaaccacggcgtgcagatctacggtggccacggtttcatcgccgagtggggcatggagcagaacgttcgcgacagccgcatttccatgctgtacgaaggcaccaccggcatccaggcgctggacttgctgggccgtaaagtgctgatgactcaaggcgaagccctgaaaggcttcaccaagatcgtccacaagttctgccagaacaacgaaggcaacgagtcggtcaaagagttcgtcgcaccgctggctgcactgaacaaggaatggggcgagctgaccatgaaggtcggtatggcggccatgaaagatcgtgaagaagtcggtgccgcgtccgtggattacctgatgtattccggttatgcctgcctggcttacttctgggccgacatggcacgcctggctgccgagaagctggctgccggcaccaccgaagaggcgttctacaccgccaagctgcagaccgcgcgcttctacttccagcgcatcctgccgcgtacccgcactcacgtggcggccatgctgtcgggtgccaacaacctgatggacatgaaagaagaagatttcggcctggcttactaagccctaccggcatctcttcagaggccgcttctccttcgggagaagcggcttttttgtgcgcgggatgaatctgaaaataatccgactaaaacgttaagaagaagccgatccctgccgttacaaaagtggcaatgtgacatgcatcacatttgtgctgtttaaccatgccaggtgaaggcatagtgccatctactgtttaaccgcgtcggagctttaccttgccgcgttcttctgctgtacgtttcagccattttctaccgtcattgttacttttgcttgcggggctcgcggctgcctacgtcaaggatctcaacgtcttcttcacctcgctgttcaacgtcttgccgaccctggtgctgctgctcggcggtgcttattgcgcggtgtaccggcgccagcgtgaactgttcctgatggtcacggtgtacatcgcctatttcctgctcgatacccagaccgactattaccgcgacaacggcaaggtgcgcgaagatgcggccgtggtgttccacttggtctgcttgctgctgccgctgctgttcggcctgtttgcggcctggcaggagcgtacccacctgttccaggacatggtggcgcgctttgccgtattgctcgcctttggcagcgtggcgctgggcctggagcagagttatccccaggcgctgctggcctggctggcagaaatccgttggccggccctgcacggagcctggatgagcctgatccagttgtcgtacccggtgtttatcgccgccttcctgttgctggcgatccagtactggcgcaatccacgcccgctgcatgcggcgcagctggtggggctgctggggctgttctggatgctgcccaagaccttcatcctgccgttcaccctgaacatcatgtgcagccaggtgatgctgatgatcgctgcggccgttgcccacgaggcgtatcagatggccttccgcgacgaactgaccggcttgccggggcgtcgcgccttgaacgagcgcatgcagcgcctgggtcgcaactacgtgctggcgatgagcgatgtcgatcacttcaagaaattcaacgacacccacggccacgatgtgggcgaccaggtgctgcgcctggtggccagcaaactgtcgaaagtcagtggcggcggtcgtgcctaccgttatggcggcgaggagtttgcggtggtgttcgccggtaagaccctcgaggaatgcatgccgcacctggaggtcattcgcgagaccatcgccaactacaacatccagttgcgcaatcaggagaaccgcccccaggacgaccagcagggtcgccagcgccggggtgcggccgcggcatccagcgtatcggtgaccgtcagtatcggcgtcgccgagcggcagatggagcaccgctcgcccgaggaggtgctcaagtctgccgaccaggcgctgtacagcgccaagggcgcggggcgtaactgcgtcatggccttcggtcagagccgccgtggcgcggtgcgcatggacaccgctgcgggttgagtgatagcggcgcattcagcgtctggactgtgattggcaggtcggatgagcggcagtaggttggatcgatctgctgccggagaaacgaccatgcccgagtacaaagctcccctgcgcgacatgcgcttcttgatcgatcacgtcttcgactttcacaccagctacgccgccctgggggccagcgatgccagcccggacatggtggccgcgatcctcgaagaaggggcgaagttctgtgaaaacgtgctggcgccgttgaaccgcccgggcgatgaagagggctgccatttcgacaatggcgtggtcaccacgcccaaaggcttcaagcaggctttcgcccagtatgtagaaggcggctggcacggcctggcggcggacccgaactacggaggccagggcctgccgcattcgctggggctggtgatcagcgagatggtcggctccagcaacacttcctggggcatgtacccaggcctgacccacggcgccatgtcggcgattcacgcccacggcagcgaagagcagaagcagacctacctgagcaagctcaccgccggccaatggaccggcaccatgtgcctgaccgaagcccattgcggcaccgacctgggcatcatcaagacccgcgccgtgccccaggccgacggcagttatgcggtctccggcagcaagatcttcatttctgccggcgagcacgacatgagtgaaaacatcatccacctggtgctggccaagctgccggatgcgccggcgggcacaaagggcatttcgctgttcatcgtgcccaagttcctgcccaacgccgacggcgaggcgggtgagcacaatggtgtgagctgcggctccatcgaacacaagatgggcatcaaggcttcggccacctgcgtgctcaacttcgatggggccaagggattcctgatcggtgaggccaacaagggcctgaattgcatgttcaccatgatgaaccacgcgcgcctcggtaccgggatgcagggcctgtgcctgggcgaggccagcttccagggcgcaatcaaatacgccaacgaccgcctgcagatgcgctccctgaccgggccgaaggcgccggaaaaggccgccgacccgatcattgtccaccccgatgtgcggcgcatgctgctgaccatgaaggccttcaacgaaggtaatcgcgccctggcctatttcaccgcgcagttgctggatgtggcgcacctcgctgccgatgaaacccagcgccaggatgccgagaacctgttggctttcctcaccccgatctgcaaggccttcatgactgaaaccgggctggaggtgaccaaccacggcatgcaggtgtttggcgggcatggcttcattcgcgaatggggcatggagcaactggtgcgcgactgccgcatcgccccgatctatgaaggcaccaacggcatccaggctctggacctgctgggacgcaaggtgctcggcagccagggcaagttgctgatgggcttcaccaagatcgtccacaaattctgcgtggccaatgccgagcatccacaactcaagggttatgtgacgcaactcgacgggctcaaccggcagtggggcgtgctgaccaccaaggtcgggatggcggcgatgaagaaccccgacgaagtcggcgccgcggcgctggattacctgatgtacagcggttacatcatcctcgcctacctgtggctgcgcatggcgctggtggcccaggcccggctcgacgccggtgaagaggatgccgattattgccaggccaagctggcgacctgcgagttctacttcaagcgcttgctgccgcgtaccgcggcccatctggcggcgatcgaggcgggcagtgactgcctgatgaagttgccggcggagctgtttgcgctctaggttttcatgtaatcgtccatcgcgggcaagcctgctcctgcagatatttgtgggagtgtgtttgctcgcgacctttggtgactaaaaattacattgaagtcatgagttgaccctatgtgtcgcaaaagttgttcgggtacactcgagttttcgtaactggggccgttcgggtccacttgtttagatcttgcgaggtttgccatggctgactacaaagcgcccctgcgcgatatgcgcttcgtcctcaatgaagttttcgaggtcgccaaactctgggccgaactgcctgctctggccgacaccgtcgacgctgaaaccgtcgaagcgattcttgaggaagccggcaaagtcaccggcaaaagtatcgccccgctgagccgcggcgccgacgaagagggctgtcactggagcgacggcgcggtcaccacgccagcaggttttccacaggcctatcagacttacgctgaaggcggctgggtcggcgtcggcggcgatccggcctacggcggcatgggcatgcccaaggcggtatcggcccaggtcgaggaaatggtcaactcggccagcctgtcgtttggtctgtacccgatgttgaccgcgggcgcctgcctgtcgatcaatgcccacgccagcgaagaattgaaggcggcctacctgccgaacatgtatgcaggcgtctgggccggctccatgtgcctcaccgagccgcatgccggcaccgacctgggcatcattcgcaccaaggccgagccgcaggccgacggctcctacaaggtcagcggcaccaagatcttcattaccggcggtgagcacgacctgaccgagaacatcatccacctggtgctggccaaactaccggacgcaccggcggggccgaagggcatttcgttgttcctggtgccgaagttcctggtcaacaccgacggcagcctgggggcacgcaacccggccaactgcggttcgatcgaacacaagatgggtatccaggcctcggccacctgtgtgatgaacttcgacgaagccgtcggttacatcgtcggtgagccgaacaagggcctggcggcaatgttcaccatgatgaactacgagcgtctgggcgttggtatccaaggcctggcctcgggcgagcgttcctatcagaacgccgtggaatacgcccgcgatcgcctgcaaagccgttcgccgaccggcccgcaagccaaggacaaggtcgctgacccgatcatcgttcaccctgacgtgcgccgtatgttgctgactatgaaagccgcgaacgaaggcggccgcgcgttttccacctatgtggcgatgcagctggataccgccaagttcagcgaagacgcggtggtgcgtaagcgcgcggaagatctggtggccctgctgacgccggtggccaaggccttcctcaccgacctggggttggaaaccacgattcacggccagcaggttttcggcggccacggctacatccgtgaatggggccaggagcaactggtgcgcgatgtgcgcattacccagatctatgaaggcaccaacggcatccaggcgctggacctggtcgggcgcaagatcgtcggcagcggcggggcgttctacaagctgtttgctgacgagattcgccatttcaccgcgaccgccagtgccgatctggccgagttcaccaagccgttgaacgacgcactggataacctggacgaactgacggcctggctgctggatcgggccaagaccaatccgaacgaaatcggcgcggcttcggtcgaatacctgcaagcattcggatacacggcgtacgcctacatgtgggcgttgatggcaaaagccgccctgggcaaggagtcgcaagacgatttctacgccagcaagctgggtaccgcgcgcttctacttcgcccgtctgctgccgcgtattcactcgctgagcgcatcggtgaaggcgggtagtgagtcactgttcctgctggatgcggcgcagttctgagcatggctacgtcgtgtaagcattctcttacatgacgtgctgctaatcacccatatcggcagattggatccagagctaatctacttcacatggacgtcgcgcaggaagcgcaaagcaataacacggacacgtaggattccgccaggatggtggagtgaaaaggatgtcagggaaacagtctgcaaagccccgcttcggcggggttttcttttgcccgcgttttttacctgcgctgcttcaacccagcccttccagcgtcgccgggcctgtcatccgcccatccgggccgctcatctcttcttccagcaaggttcgcagcaattccagggttgcctgctgacgctgcacatcacgacataccagccccactttcaacggcacccttggttcgctcagcggtttccataataggtccgtatggctgtgggtctgtcgcgatcgccccggcaagaccgtcgccaggcgggtgttgggcaagctgtcgagaatccccgccatattgttcagctccgcctgcacttgcggccggcgtccgaggttggccagttgcgcctgccagatctggcgtatctggaactcctcgcccagcaacagcatgggcagctccgcggcctggctcatggagaccttcttgaattcgcgcaggggatgttcggcaggaatcaccagggtcaactcgtcttcgtagagctgcacaccgtgcaaccctggctggcgcggcggcagataactgatgccgatatccaatgagccattgagcaggcgccgttcgatttccaggccggtcagttcgtagatctgcacaaccagatgtggctgggccttgcgcacccgctcaagcatttgcggcaccaggctgctgtgcacggtttgcagtacgccgatcgccagcgtgcgcagggcctggcccttgaagttgcccagggcttcacgagcccgttgcatgccgtcgagcaagggcagggcatggttgtacagggtatgggccgccagggtcggcaacaggcgcttgctgctgcgctcgaacaggctgacatcgaggttctgttccagctgacggatctgttgcgagagcgcgggttgggagatcgacaggcgctcggcggctcgtcccacgtgaccttcttcatacaccgcgacgaaataacgcagttgtttaaaatccataagttctgcttatcgaaaaagctggaaaatcgaaatggcccgataggtcgcagaagcctagtctaacccctattcacagggcttacagggccagaaggcgagatgaataccgtttacgtggatggtgtttacataggcaaggcaaaaaacctcggacagggtttggtcagtgatacggacaaacgcccggttgcaaaccgactctggttatggccgcagggcctgggcagcgacgaacacggcgacccgcgctttcataccggcccggagcgggcgctgcaccattaccccgccgaacactacagctactggcgcaagcgttatccacagatcgactggtgtgccccggcctttggcgaaaacctgtctacccacggcctgaccgaggaacaggtctgcctcggcgatatgttccgctggggcggcgcgctgctgcaggtcagccagccgcgttcgccctgttatcgcctgagccaccgctggggcatccccgacctgccgcaacaggcgcaaaacaatggtcgctgcggctggttctaccgagtgctcaagcccggcttcgtcagtgccgatcagcccttcgagctgatccagcgcagttacccggggttgaccgtggcctgggccttgcgctgtttttatcgagaacctctggagcatgcgggcttgaagaaactggtggactgtccggcactggcgtcgcgttggcgcgacatcgcgatcaagcgcatgcgcaccggcctgatcgaggattggtccgcgcgcctgctgggcctgccactgcaggggttgagcgcatgaacctgttcagcctgcgccgccctcagccgagccttgatgatctggcggccgagccctgcccgtcgccgacgagcgacaacctttccagtgagtgcctgatgcccagcgtccagcgaccccacccagtgtttgtacgtggccagggctcatggctgtgggacagcgatgaccgcgcctacctcgacttcgtccagggcaacgccgccaacagccttggccatagcccgtcggcgctggtcaaggcgctgacggcccaggcccagtcactgatcaaccccggctcgggcttttacaaccgcggcatgctcaacctcagcgagcgtttgtgccgcagcaccggcagcgaccaggcctatctgctgagcagtggcagcgaagcctgcgaggcggcgatcaagctggcccgcaaatggggccagctgcaccgcggtggggccgcgaagatcatcactgccagcggcagctgtcatggtcgcagcttcgcggcaatgtcggcgtcggcaagcacccatatcgccaatcgtttcgagccacagctgtcgggtttcagtcatgttcccttcaacgacctgccggcgttgcatgctgcagtggacgcgcagaccgtggcgatcatgctcgagccgatccagggcgaggccggggtgattccggcgaccgagcattacctcaagggggtcgagcgcctgtgccgcgagctgggcatcctgctgatcctggatgaagtgcagaccggcatcggccgttgcggcaccttgctggccgaacaagtctatggcgtgcgcgccgacatcgtggccctgggcaaaggtctcggtggtggcgtgcccttggcggctttgctggcgcgtggcaaggcctgttgcttcgaggtgggtgagctgaacggcacccatcatggcaatgcgctgatgaccgccgcgggcctggcggtgctcgatagcgtactggacaacagctttctcgagcatgtacgggacaacggccagtacttgcgcgaagggctggcccgcctggcgaatcgttatgcccagggagaactgcgtgggcagggattgttctgggggctgagcctggccgacgactcggccgaggccgtggtcaaggcggcccgctacgaaggtctgttgctggccgcaacccaaccggactgcctgcgctttaccccggcgttgacggtgagcaaggccaacatcgacgaaatgctgctgcgtctggcgcgggccttttcgcgagtacgcaccgcgcagctgcaatgccgcaaggggctggtggtttgaagcctggcctggtcccgccactcccgatcttgcactgacagaaattcccgaaccgtctcgcggtataacgcatcgccccgtgtccgatctttcgcacggggcgtttttttgtctcgggcttttgcaaaactgccatcaggccttgaaggccatcatccaggcaaggttccttaggctcatccaccaggacggtggggggctgctggggcgcaagaccaccgggcagcctgggttgaatacatataccactgagtggtatgtttttgggaagggaagccatgacaatcaggttgttcaaaaccaaaggttttgctgttgcggctaaaaaagccttgatccatgacgaccagttgctggccgcattcagcgagttatgcaaaggccaggctgatgacctgggtggcggggtctggaaaaaacgcctgaacgccaaccgccatcgttcgatcgtcctggccaggggccggcgctactgggtgttccagttcctgttcgccaagcaggaccagagcaatatcagccaccaggaactgcaggcattccgcgcgctggccaaggcctacgaagggctggatggctggcaggtccagcagctactcgagatgaaagcgtttgtggagatcagacatgagcaagccattcaagactgaagcccttgaatcgatacacgagtcggccagtgccctgcacgccatcggcgccatcggcaaaaccaccatgcgccagttcgatgaagcatgtatcgcgccagtaccagcgagtattccggcggagcagatcaagttgctgcgcgagcgtagtaacgtcagccagccggtctttgcccgctacctgaacaccagcgcgtccacggtgaagcagtgggagtctggcgagaagcacccgagcggcatggcgttgaaactgctgagcatcgtgcagaagcacggccttgaaatactggcgtgagccggcactgaaacaccggccagcctggggatctggcccttggccagaatcgattgaaccctgccgaacgccatgggtcgattagcggtgaggctcatacgagtcgattgctatcaggagctgccccatggactttatccgcatcatcatcgccattctgttaccgccattgggcgtgtttctgcaagtggggttcggcggcgcgttctggctgaatatcctgctgaccctgtgcggctacatcccgggcatcgtgcatgcggtgtacatcatcgccaagcgctgagcctggcgcccgctccgcagaggagcgggctggttccccttggacgccgattattccggtgcgtccgtctgttccattacctgccgataaaacagccattcctgttccagggcgtgcgcctgattggcggccttgcgaaaaccgtggcgctcgtccgggtaatagtgcgcttgggccgtaatgccgttgtcctgtaacgccttgagcatgtcccgggtctgctggggcactaccacggcgtcgagttcaccctggaagaaaaccactggcacgcggatattgccggcatgcaacagcggggtgcgggccttgtagcgttcggcatcctgttcggggtcgccgatcagccagtcaaggtagtcgccttcgaacttgtgggtgtctcgcgccagggccacggggtcgctgacgccatacaggctggcgccggcacggaacacatcggcgaaggccagggcgcaaagggtggtgtagccgccggcactgccaccgcggatgaacgcccggtcgccatcgatcaggccctgtccggccagatacgcgaccactgcgcaggcgtcctccacatccacttcgccccagctcaggtgcagggcttgccggtactcgcggccatagccggtgctgccgcgatagttcaggtcggccacggcgaacccccgttgcgcccagtactggatacgcgggtcgagtatcggataacaggccgaggtggggccgccgtggatgaacaccaccagcggcggccggtcgtcatcgctcatggccgggtagaaaaagccgtgggcctcgccctggccgctggggtaacgcagggtttgcgggcggctgatctgctcgggcagcaggggcgctacgccgccagccaggaccttgacctgctgtgattggcggtcaatggcgatcaccgcggacggactcacaggcgacgccgcgatgcagtagataaaccgttcatccagcgccaggttgcggaagcggctgtagtcgccgctgaagtcctgttgctcaccctcggccaggcgcagccccaagcggccaaaaccggcttgcgtccaggtacccagccagttgtcgccgcccagcggcagccaggtgcagccgcccaattgccagggcgccggggcgtgatcggcggcggcgcagggcagcgcttgcaggccgcttggggtttcaccccagggttgccagaagccggcgcggtcggtcaggcagtacagccgcccggcttcatcgaaacatggttgttgcagcgactcttcctcgccatcgccggccaggcaccgagggtcatcccagcggccgttggccaggcgctcggcgaccatcaggcgggtcgaggtccagggctgatgcggccgatcccattcgatccatgccaggcgctggccgtccgggctcaaggtgggcgccgcgtagaagtccgccccttcggccagcagctggcgttttccgctaccggagtcgatggccaccaggcgatgccggttgttgtgctcttccactgccagcacctggccggcggcgaactgcaggtcgccataacggcactcgccgcaggtcagggctaccggcgcttcgccttgcagggactgtcggtagagctgctggtccgcctcgttgacgaacaccagcccgtcatcgctcaggcaaaaggcgccgccgccgtattcataaacccggctgcgcacgctgaaaccttgcggcgtcaggcagcgggcctggttgtcgcgccagtgccagatacggcaggcggcgtcttcggggcggtattcgttccagaacaggccgttggcgccgagccgcagttcggcgaaatcgatgccggcggcgacggctttggcggcgctgaaggattcagcccttggcgatgaggcgcgagtttcgttcattacggaaggccagttgctcgatggtctgggtggcgtgctcggcttcttcgcgggccttgagaatcacgccgtgatggtgcgacttgctgcagaccgggtcggcgttgctggcgtcgccggtgagcatgaaggcctggcagcggcagccaccgaagtccttttccttttcatcgcaggagcggcacggctcgggcatccagtcgtagccgcgaaagcggttgaagccgaaggagtcataccagatgtgctgcatgctgtggtcgcgcacattggggaattgcaccggcagctgccgggcgccgtggcagggcagggcggtgccgtccggcgtgaccgtgaggaagatgctgccccagccgttcatgcaggctttcgggcgttcctcgtagtagtccggggtgacgaaaatcagtttgcacggatgcccttcggcttccagtcgggcgcggtattcgttggtgatgcgctcggcgcgtaccagttgttccttggtcggcagcaggccgacgcggttgagctgggcccagccgtagaactggcaggtggcgagctcgacaaagtcggcttccagggcgatgcacagttcgatgatgcggtcgatccgatcgatgttgtgccgatgggtgacgaagttcagcaccatcgggtagccgtgggctttcaccgcccgggccatttccagcttctgggcgaaggctttcttcgagccggccagcaggttgttcacctgttcgtcgctggcctggaaactgatctggatatggtcgagcccggccttcttgaagtcgctgatcttctgctcggtcaggccgatgccggaggtgatcaggttggtgtagaagcccagcttgcgcgcctcgccgatcagctcggcaaggtcctggcgcaccagtggttcgccaccggaaaagcccagctgcgcggcgcccatctcccgggcttcgcgaaacaccttgagccactgctcggtgctcagctccttgccctgctcggcgaaatccagcgggttggagcagtatgggcattgcagcgggcagcggtaggtcagctcggccagcagccacagcggcaggccgacttccggtttgggcggtatcggcgctggcgaatcagccaagttcgatccagtgctgtgcacgggcgacctccatgaattgctcgatgtcgtcaccgagttcgggcacgtcggggaactggacttgcagtgcctggatgatcgccgcgacatcccgtccaccgtcgatcaacccgccgatcagcgcggcgctctcgttgagtttgatcatgccttcagggtagagcagtacatggcccttctgcgccggttcgtactggaagcggtagccggggcgccaggtcggggtcttgctgcgatcgaagctcatagggtgattcctttatgccagacccgttctgtggtgacgctgtgatacggcgggcgattgagttcataggccatgctcatggcgtcgagcatgctccaaaggatgtccagtttgaactggagaatttccagcatgcgctcctggccggcgcgggtggtgtagtgctgcagggtgattgccagcccgtgctcgacatcgcgccgcgcctggcccaggcgggtgcggaagtattcatagccggccgggtcgatccatgggtaatgctggggccagctgtcgagacgcgactggtggatctgcggcgcgaacagctcggtcagcgagctgctggcggcctcctgccagctggcgcggcgggcgaagttgacataggcgtcgacggcgaaacgcacgcccggcagcaccagctcttgcgagcgcaactggtccgggtcgaggccgaccgcttgtcccaggcgcaaccaggcctcgatgccaccgtcttcgccgggggcgccgtcgtggtccagcaggcgctgaatccactcgcgacgaatttcccgatccgggcagttggcgagaatcgccgcatccttgagcgggatgttcacctggtagtagaagcggttggcgacccagccctggatctgctcgcgggtcgcccggccctggtacatcgccacatggtacggatggtggatgtggtaataggcgcccttggcccgcagggcctgctcgaattcggcgggggacattgctgtgtcagtcattgcggttctccgcagggaggtcctggatctgtggtgtctattctggacttatcgcgagcaagctcgctcctacaggacagcgcaatcttttgtaggagcgagcttgctcgcgatagaccgcgaagcggtcccggcaattacagctcgatactcatgccgtcgtaagccacttcaacgttacgccgcgccagctccgcgcgttcggcggaatcctcgtcgaggatcgggttggtgttgttgatgtggataagaatcttgcgctgctctggcaactgctccagcacttccagcatgccgccagggccgttctgcgccaggtggcccatttcccgaccggtccgggtgccgacgccgcgacgttgcatttcgtcgtcttcccacagggtgccgtccaccagcaggcagtcgctgccgctcatgatttccagcagcgccgcgtcgaccttgcccagccccggggcgtagaacagcttgccgccggtgcgcaggtcttcgacgatcaggccgatgttatcgcccgggtgcggatcgaagcgatggggcgaatagggcggcgcggcgctgcgcagcggcagcgggctgaagcgcaggttcgggcaggccgggatggtgaagctccggtcgagctcgatgcggttccagtccagcccgccgttccagtgggtgagcatggtgaacagcgggaaaccgctgctgaggtcttcgtggaccatgtcggtgcaccagacctgatgcgggcagccttcgcgcaggctgagcaggccggtggtgtggtcgatctggctgtccatcaggatgattgcgctgatcccggtgtcgcgcagggcgcggcccggttgcatcggggcgaagccctggagctgggcgcggatgtccggcgaggcgttgcacaggacccagttcacgccgtcatcggaaatggcgatcgacgattgggtgcgagcctttgcccgcaggctgccgtcgcgaaagcccgcgcagttcgcgcagttgcagttccactgcggaaaaccgccaccggcggcggaacctagaatctggacaaacatggccgctccatcaggttaaggctgaaaataaaaacgccccggcgagccgaggcgttgcactgcgcgagcaatcaacggctggcgaagtacatggtgacttcaaagccgatacgcaggtcggtgtaagccggtttggaccaggacataaaggtgctccttcaggtgggtgggacggttgagatctatacatatagtccacctccaactggagatgttcagatgcttagggggctatcttactaaattccccccggggaatgactgcaattgttgaagaaagctcgttgcagccagggtaacgatcattttcccgcttgccagggttcgcccgggcaggcaccgctggccaggcagcgccagccgccttgcgcctgctgcaactgttcggccgcgagcaacagctgtggccggggcgctgccatgattttctgttgcaattgctccaggtaatccgacggatggccggccagtcggccctgccagagcagctcggccagttgtgccacgggcaatgcacgggcatcgaactgggcggccaggttagctttcaagtcgtccagggaggcgtcatccagtgcctcgatcaactcgggcaactgcgccaggaacccccggatatgctcgaggatctcgctcagtgacgcgctgggagactgcacgccgaacagcaggccggtctggccattgatctgtcgcacaccgctgaacactgcatagcccagttgcaactcgacccgcaggcgctgatagaacggcatctggccaagctgcccaagcagccgccagctggcttcctgctgaagggtggtgtccggtgccgggcaaaacagcagcagggcctgctcgcccccggagccggttgcgacctcatgccagtgctgctgcgcggctatcgagggtggcgcagaaagctggctgtcggcggtgcccggggctttgctcaatgccgcgctgatcgcgctttgggcatgggccaggccgatggccaggccatcccagtgggcgccctcccacagcgtttgccagccttgttcatccagtggatgcggctcctcgctggcgggtatgtccaggcagcgctcgggcagttcctgaagcaattggcggatcggcaacagcggcgcgggagcagttggggggatttgccagaacgccgcgccgggttcgctcagttccagcagagcctgctggagcatggccggcatcggttcgggaagccccttcagcgtcagcaagcactggttgcccgagacaccgaaggacagctcgacgcccgcctgaagtccgtcgtcccgcaggttgcgcaggtggttttgcaagcggctgcgcagctcctgcggcaacacgctttgcaggcgccagcgcaagtacagggctgcctcgccagcgtcgtcggtgatggcttggctgaaggtcatcgccgaggattcgcgacgctgccgcaagcgatcctgggcgaaggtgcgcaagccgcggtgggcgctggtttgcccgcgaatcaggccggcccgggcggctgacgccgagctgcgcaggaacggattgggcgcaggcagttgccagctgatgtcgctggctgccgacggggcttgaagctccgacagcagggccttgagggccgtgacgccgcggtcggacagctgcggttccaactgctcgttgttcagtcttgccaacgccagtgcgctggcgacctggcgttggcgctgttgcagcagggcgtattcgtcgcgcagtgccggccagtcctcctggctgctgaaaaaggccagccaatcgaagaacaactcactcacctgctccggctgttgggcgccttgctcggtcaagtcgaactggatatgcagcagcgcctggccggcaaactgatacagcggcgcggccttcaacccttcgaccagcttgcgctccttgagcatggccagcagcccgccggatttgccgcaggccagccaggtgcagagaaaatccagcgcttcgcgggcggccgtgggcagttgctcgcaggcgaacagcaggttcaggtggcgcccgtcgagctgccgataatgctgctgtgcagacgtcagcaagggcaccggggctgtttgcggttgcgctttaccgacggcgaggacggcgccaaaaccttgtgccagggccttcagctcttccagcgactgtgggccggccaggctcagggacatttgcccgctgtggtagtgagcctgatagaaggcttgcaacgcctgttgaaacgccgggcgcggcacgttgaggctgtagcgattgccggcgtggaacgcccgcaggggatgctccgtggacaggccgtcgagcaaggcgaattgccgttgcgccgtggcatcccgcgaccaggcgatgaactccgcgtgcagcacctcacgctcgcgcaactggtcttcctggctcatgcgcgggtgggcgagcatgtcggccaggcgctccagcccgccggcgaaatccgcggggggcagttcgaagaagaagtcggtgtggcgttcgccggtgctggcgttcacctggccaccgtggcgttgcacataggccatcaggccctgttgcgcgggaaagcgctcggtgccgagaaacagcaggtgttcgagaaagtgcgccagcccgggccaggccagcggtacatcgtgactgccggccgagacccgtagggccgccgcgcagcgcttcaatcgagggacgtggtgcagtgaaacccgcaggccgttggccagggtttcccgatgaggcagagggtggttcagcgcgggcatgagcacttccagaacagtgaagcgcccatgctagcggataaccccggatcagcgcttgttcaggtcgtcgtaaagctccgggcgacggtcatggaagtagcggttggcggcgcgggaatcgagcatcaactgacggtccagcgtgccggttatcagggcttcatccagcccggcgagggcaatccgctggccgtcgggggcggcgatgctgctctggccacagtagtggatctcgtcttcgtggccgcagtagttggcgtaggccacataacattggttttcgaaggcgcgcgaacgcacggtgacatcggcgatgaagtcgtagggcagcatgttggcggtgggcaccagaatcagttcggccccggccagcgccaggcgcctggcgttctccgggaattcgatgtcgtagcagatcaggaaaccgagcttccagccgttgagttccaccagggggaaatcgtctggacctgcgctgaacatcgagcggtcgagatcgccgaacaggtgggtcttgcggtagttgcacaggcgctggccgttgcggtcgatcagttgcacggcgttgtagatctggccgtcgtcggcgcgttccgggtagccatacagaatcgcgatgcccgccgactgggcgacattggcgatgtattgcgccgacgggccatcctgggcttcggccagggcgcccaccgcttctacgccgatgttgtagccgctcaagaacatctccggcagcaccagcaggtcggcgccggaagcttccacggcgaccttctgcaggcgttgcaggttgccggcgacatccagcggttgtggggcacattgataaagcgctacacgcatggtgatgactcctctgtgcgctggactgtcactgtagccgttgccgcgggccgctcaaaggccacgagcgttgcgctcgatcgcagcctgtggcagcggctacaggttcagtcggccagggcgatcgggccgatttcgtggaacacgtcgcccggtcccgggttttcggcgtgggtctgcccgccgaagtgcttcatgatgccccagaccgcgttgagcgaggtctgtaccgcgccctcgacccaggccggagtccaggacacatcgtcgccggcgatgaagataccgcgctgttcggcgggcaggtcgtcctgcatgaagtgcgcgtacatgcgctggttatagcggtagtggccgggcagcgcgcccttgaacgcgccgaggaagtgtggatcggcttcccaggacacagtgatcggatcgccgatgatgcgtccggcgatgtcgactttcgggtagatcttcttcagggcgtcgagggccagcttgacccgtttttccaccgggtgcggcagcatcttcagggcgtcgctcatccacgaataggacaggcagatgaccccaggcttgtcgtcgccgttatcgaacaggtaggtgccacgggtcaggcggtcggtgagggtcatgctcatcaggtcgcgaccggtttccgggtctttgtctttccagaacggccggtcgaccatgacgaaggtcttcgacgattgcatgtagcgggtgcggtccagggccatccacatcttctgcgagaacagcgactcttcgcattcgatctgggtggtcagcagccagctctggcaggtggtcagcactgctgcgtattcgcgggtatcgccccagttgtcggtgacgctgaagcggccatcggcggcccgggcgatgcgtttcaccccgggacgcggcgcgccatggtgcagtgagctgaggctggtgccttgtggccagtgggcgcagcgctccggcacatggcgccagatgcccagtggcacctgctcgacaccaccgaccaccaggtgctggtgatcgtcgcagttggtcatcaccacacggaagatttccagcatcgaattggggaaatccgaatcccagccgccggtgccgaaaccgacctggccgaacacttcgcggtgatggaacgacagcttggcgaaggccttcgaggtggcgacgaagtcatagaaggtgcggtcgtcccacaacggcaccaaggtgttccacagttccttgaggcgcggtacgtcgcgctcgcggatggcctgctggatttcgctgaagcgcgaaccgtcttccagggcatcggcccaggcgtcggccacttcctggaacagcgccggcaggtcggcgagcttctgcgcgtagtgagtctggccttcgaggtcgatcaccgtgctgccggaagccggggtcagcgggttgggaaagggtttggtctccagacccagcttgtcgacgtagtgatagaaggccgtggaggacaccggaaagcgcatgccgcccagttcggcaatgatcccttcggcgccttcgaacgcctgggagcgcagccggccgcccattttcgaggcttcgtacaccacgggcttgaggcccagcttcatcagctcgtaggccgccaccagcccggcgataccggcaccgacaatcgccacttcggcgccatggttggcttcggggatgctgcccaggccggcggggtgctcgatccagtcgtcgaaggcgaacgggaagtccgggccgaaaatggtgatgggtttcttaccgtctgcaggatggcgattgttcttgttcatggctgaccttgctggcgactcgagcagagcgctgagtataggaaaagatggcagccattctagggagcgttgcttacgttaataagacgcaaaatgtcgtcgttttggatgattttatttcaatctgacgatgttttttaactaactgacgagaaaatctctatagccgctgccgaaggctgcgatcgagcgcgaagcgctcgcaaaacagcgggttaccgtgcctggaaaaaccttcagacgggctgcccacggtcgatcttgctgctgagaatgatcgaggtggtggtcttttccacaccgtcgacgctgccgatctggtcaagcaactggtccagctgttccggcgaatcggtgcgcagccaggcgacatagtcgaattccccactgaccgcgcagagctgctggacctgggccatggcgctcaggcgccgcaggacctccttgccggaacgcggctgcaccttgatcccgacgtaggcctgcaagccgccatcgatgactcgctgacccaggcgcacgccataaccggtaatcacccgcgccttttccagccgcgccaggcgcgaggtcacggtggtacgggcgatccccagttgccgggcgagcatggccacgctttcgcgggcattgatctgcagggccgcgatcagttggcggtcgatttcgtcgaggacgggagggcggctgtcagacaaggtggactccggcgcgggcaacggtggccgagcatgttacaggctcgctgggggcgatgctcgtggcatgacgtattggctgcggactgcgctatgacggctaggctcagtagcacagaagagattttttgccacgaattgcctgcgacaagttgtcataagtaactggttagtacattcttgcgccacgcaaagaatgggagaaatttccgacatgaataattctggggctgccaccggcagcaaatggttgttgtgggcgctgggtgtgctgatcgccctgatcggtctggggctggccggcgggggtgggtacctggtcagcctgggcggcagctggttcttcctgctgatgggcctggcgatgatcgtttccgggctgctgatcgcccggcgtaacccgcgcggtgcctggctgtatggggtggcgctggtgctgacggcaatctgggcggtctgggatgccgggctggagtactggccgctggtttcgcgggtgctgaccttcgccgtgatcggcctggtggtggcgctgatctacccgaccctggtgcgggcttcgggcgcgaccgccggccgtggcgcttatggcctggcgggtgtgctgggcattggcgtcgtggcgaccctggcctacatgtttgtgccgacccatgtggtcaaggccagcagcgagccggcgatcaagcctgtggctccaggtaccgagcagaaagactgggcccattggggcaacaccaccgccggcaatcgttttgccgcgctggaccagatcaacaagggcaacatcgaccagttgcaggtggcctggactttccgcaccggcgatattccgcaaagcaccggcgcgggcgccgaagaccagaacacaccgctgcagatcggtgacacggtctatacctgcaccgcctacggcaaggtgttcgccctggacgccgacaccggcgccgaacgctggaagttcgatccgcaaggctcggcacctaactggcagcggtgccgcggcctgggttacttcgatgcctccgccgagcctggcgccgaggcaacggccgctccggccgcctgcaccaagcgtttgttcctgccgaccggcgatgcgcgcctgatcgcgatcaacgcgcaaaccggcaagccgtgcgaagacttcggcgacaaaggcacggtcgacctgaaaaccgacatgggcgaagtgaagcctggctactaccagcagacctcgactccgctggtggccggcaatgtggtcatcgtcggcggccgggtggcggacaactattccatcggcgagccgccgggcgtggtccgcgccttcgacgtgcgcagcggcgagctggtctgggcctgggatccgggcaacccgaacaccaccaagcgtccaccggcgggcgaaacctacactcgcggtacgccgaacgtctggtcggccatgtcctatgacgccaagctcggcctggtctacctgccgaccggcaacgccacgccagacttcttcgctggccagcgcacggagttcgacgacaagtggagttcgtccatcgtcgccctggatgtgaagaccggtcaggtgcgctggcacttccaggccactcaccacgacctgtgggacttcgacctgccggcgcagccgctgctgtacgacgtgccggacgacaagggcggggtgcagccggcgctggcgcaggtcaccaagcagggtgagatcttcctgctcaaccgcgaaaccggcgtgcctatcgcccgggtggaagagcgtccggtgccgcagggcaatatgccgggcgaacgctactcgccaacccagccgttctcggtggagatgccgtcgatcggcaaccagaccctgaccgagtcggacatgtggggcgccacgccatttgaccagttgatgtgccgtatccagttcaagggcatgcgccatgaaggtgtctacaccccgccgggcctggatcatgccttgcagttcccgggctccctgggtggcatgaactggggcagcgtgtcggtggacccgaacagcaactatatgttcgtcaacgacatgcgcctgggcctggccaactacatgatcccgcgggcgcagatcgcggccggggccagcggtatcgaaatgggcgtagtgccccaggacggcacgccgtttggggcgatgcgccagcgtttcctctcgcctgccggtattccgtgccagaagccaccgttcggcaccatgtcggccatcgacctgaaaaccaggaagctggtgtggcaggtgccggtcggtaccgtgcaagacaccggtcccctgggcattcgcatgcacatgccaatcccgatcggcatgccgaccctgggggcgtccctggcaacccagtccggcctgttgttcttcgccggcacccaggacttctacctgcgcgccttcgataccggcaacggcaacgaaatctggaaagcccgcctgccggtgggcagccagtcggggccgatgacctacgtttcgcccaagaccggccggcagtacatcctgctgaccgcaggcggcgcgcgtcagtcgccggaccgtggggactatgtgatcgcttatgcattgcccgaataacggctgatcctggccttacagaaaaaccgcgcaaggcgcggtttttttgtgggcgaatacaatccgtccgagcatgaagtgctcagcgattaaccagcttgtcgagttcgtcgagactgatcttgggaatgatcgaagtagggatgctcgacgtgggggacaggttgtagaccgagaaatccttgcccatgaccttgtccgacatcagtttcaaggacggcaggatccgcgattgcaggtgctggtccaggccgcagggcgacttgaaggtatctggcgtttcataaaaacgcccctgggcaggattcaggtcgacgcccaccaggatcgccgtattgaagccggcgtgataggcgagttgcagtgccagataagccaccgtgcgggcgtcgaagaaacccagttcgagattcttgctgaagccgatggtccggctcctgttgccccagaacaggggagggcgaaccaggtcgcggttgctcctaagcaatcgctgcgtccaggtctgtcgtggcgccttcttcagcagaaacagctcgccgcgaggctggattggaacagtgcgggcatgttcttcccagagcgccacacgctgactgacagccattgcctgggtgaagagctcgggttgctggagggagaagctggtgtcggtgcaggcataaaaaaagggctgtatgccggtgccacggaacatcgagatggccccgttcatggtgatcatcgggatgttcgagaaggcttcgatagggaagtcctttgccgaactaccggatgcaatgatgaaaacagggccttgctgaatatttcggcaacgtgcaaaacccgttgcccggccaggcgaaggcgccgtagatactacttccatgtgttgtgtccgaatcatcaggccactctgattattagggggtggcttaagtggtgcatcgcgtcggggaaaggacaggctctcccccattcatagaagtgcagtttaggaccaaacaaaggtcatgcacgacttccgaacggttatgaccgtcgcggtttttaatagttgtgcggtagggctgatttcttggaaaaaacgatcgggcgttttgccggcctggcggccgaatggcgggatttgcagcgcgttgaatacgcgaaagccgcgcaatgcgcggctttcaaagatggtgggcccacacggactcgaaccgtggaccaaaggattatgagtcctctgctctaaccgactgagctataggccctcagtaggccgcggattatagcgacggtttctcggctgtgctatccgaaaaatccgaaacgggaaggcgtagaaaggtcgcggcgaattcgtcggcgctcagcggcaggctgatgatgtagccctggatctgttcgcagccttcgtttccgaggaatacctgctggtcgtgggtttccacgccttcggcgatcacggtgaattgcatgctgcggcccagggcgatgatggcccgcacgatcgccacatcgtgggggtcgtcgggcaggccgcggacgaaggattgatcgattttcaggaaatccagcggcaggcgcttgagatagctcagggacgagtagccggtaccgaaatcgtcgatggccagctgaacgcccaggcgcttgagctggtgcaggacctccagggcttcctcggcctggctcatgatgaagttctcggtgatttccagctgcaggaatccgggtttgaggcggttgtctttcagcagctgttcaatccgccccagcaggttcggctggcgcaactgggcgccggcgagattgaccgaaagcgggccgaagctgtcgtagcactcgttccacttgcgcaactgttggcaggcgtgttccagcacccagtcgccgatctgcaggatcatgccgttctcttcggccagggggatgaagtgttcgggcgggacatcgccaaaggtcgggtgatgccagcggatcagggcttcggcgcctaccagctcgtggtcgcccagcctgatcttgggttggtagtagagatacagctcgttgcgctcgatggctcgccgcagttcatattccagggccacgcgctcgctggcctgggcggtcaggtcgcgggtgtagctttcgacccggttgcggcccttagccttggagcggtacatggcggcgtcggcgttcttgaccagggtggccacgtcgcaaccgtccttgggatagaggctggtaccgatgctggcgctgatgaaaaactcgtgctcgccggcctggaacggcgcggtgaagcagttcagcagcttgttggcgatgtggtcggcatcgctgggctgctgcagcccgggtagcaggatgatgaactcgtcgccacccaggcgggccacggtgtcgatatcccgcagctgttctttcaggcgcacggcaatgcccttgagcagcaggtcgccgaccgggtggccgaggctgtcgttgatgtgcttgaagcggtccaggtcgagaaacagcacggcgccctggccaccgttctcctgttggttgttgagggcggtcagcaggcggttttcgaacagggtgcggttcggcaggccggtcagcggatcatggtgcgcctggtagtcgagcttggcctgggcgtgcttgaggctggaaatatcggcgaataccgcgacgaagtgggtgatgaaccggtctttgttgcgcaccgcgctgatggtcagccagctggggtacagctcgccatttttgcgtcgattgcagatttccccttgccaatgaccttcggcggtcagttggtgccacatggcggcgtaaaaggcgctgtcatgcaggccggaagccagcaggcgcggagtgtggcccagggcttcggtttcgctgtagccggtgatttcggtgaacgcccgattgaccgcgctgatgtgctgctgggtatcggtgatcagtacgccttcagcggtgctctcgaacacggtggcggcctgttgcagcttctcctgcatcaggtggcgctcggtgatgtcgcgggcgatggtcagcatgcagtcttcgtcgccgatcggcagcggccggctcgagagctcgcagaggcggatctgaccgtcattgcggcgaatatggcagctgaagtcgcgtacgaagccatcccgctgcatcaggtcgagcatctgccggcgctcgttgaggttgacccagatgcccagctccagcgtggaacggtcgacggacatggcgctattgaagccggtgatacgactgaaaccttcgttgacctctatcagcaagccgtcgcgctggcggcttagcagcaggccgtccggcgaggcgtgaaaagccttggcgaacttctcttctgaggtttgcagctgctgttgggtttccttcaactggctgatgtcgcgaaccaccacgaccagggcgggcgtagtgtcgaggtcgaagggttcggcggagatcagcccggtgaacagctggccgttgctgcgccgaaagggcatttccaggttacggatactgccggcctgcaagcgttgcagcagccccgggccgacgccctgaataccccagatattcagctcggtggccgtttggccgatgacttgctcggcactcaggccgatctgttcctcgaacgcctcgttgacctccagcaggcagccatccgacaggcgggcaatgaccaggatgtccgggcactgttggaagaccgaggcgaatttctgttccgagagctgcagggcctcttcggtgcgttttgtctcgctgatgtcgatcatcaggccgcgcatgatcggttcatgcccatgctcgatcaggctgacgatgtcgcgaacccacaggcagcggccgtcggcggtgattactcggtaatccaggctgtgatcgcgcccggccaggacttcgtggtcgcagaagtgctgggcgcgcgtcaggtcggcggggtggatgatgtttctccagaatccgggaatcagccagtgcgaaaggggatagcccagcaattgctcggcatggggcgacacgtagctgtaggtgaagtcgctgatgcgcgcttcccaggcgatcgccgaaaggctttcgaccaggccgcggtaatggtattcgctgctacgcagttcctgttccagggccacgcgccttgcgatctcggagctcagccggcgattgatgcggatcactgccgcgagaatggcaaacagcaggagcagccctggcaggccatagaacagcaggtccgaccagaacgaacggtggtcgagcacattgcccacccagcgctgctggatctcgttgacctccgccgggcttatgtcagccagcaccttgtcgagaatgcttaccagtatcttgctgtcgcgggggacgcccatggccagctgatagcggtagggcgtctcgccgctgacatagagcccatccagcttcagctgccgcaggctccagacactggaagccaggtcgccgaccacggcatccacctgattgagggccagcgcctgcaaggccgaactcacattgggcagggcaaccaggttcaggtcgggatggtgggtgcgtagcagttcatggggggcgtaattctccacgacggcgatcttcaggccgtacaggccctggagcttgcgaggttgcgcgccgcctttatgggccaggatcacgatggggaagtcgaggtacggacgggtgaaggccagatagttttgccgctccggggtcgacatgatgcctggcagcaggtccagcttgccctttttcgcggcttcgagcacttcgctccagctggcgggttctatcggcttgagcgtgatcgccaggcgatcctggatcagatggatatagtccgccgcaaggccctggtagcgcccttcctcatcgcgatattcgaagggcggccacgaagcgtcgacgcccaggcgcaattccggatgggcggaaagccagccacgttcttcatcggtgagtgtcagcgcgccggccgttgcggtccaggcgagcagcgacagcaccagcacggtcggcagtctgggcataacggtctcgttatgacacgggggaatgtttcgagtgtagacgggcaatccggagggagtgaggcgcggggagttttaaactgcacaaaacaaaacccccagcagggctgggggtcttggtattactcgtcgaggaaggagcgcaggtgctcgcttctcgtcgggtggcgcagcttgcgcagcgccttggcttcgatctggcgaatccgctcacgggtaacgtcgaactgcttaccgacttcctcgagggtgtggtcggtattcatgtcgatgccgaagcgcatgcgcagtaccttggcttcacgggcagtgaggccggagagaacttcgcgagtcgcttccttgaggctctcaacggtggcgacatcgattggcgactgcatggtcgagtcttcgatgaagtcgcccagatgggagtcttcgtcatcaccgatcggggtttccatggagatcggctctttagcgatcttcaataccttgcggatcttgtcctcaggcatttccatgcgttcgcccagctcttccggggtcggttcgcgacccatttcctgcagcatctgccgggaaatacggttgagcttgttgatcgtctcgatcatgtgcaccggaatacggatggtgcgggcctggtcggcgatcgagcgagtgatcgcctgacggatccaccaggtggcataagtcgagaacttgtagccgcgacggtattcgaacttgtctaccgctttcatcaagccgatgttgccttcctggatcaggtccaggaactgcaggccacggttggtgtacttcttggcgatggagatcaccaggcgcaagttggcttcgaccatctctttcttcgcgcgacgggccttggcctcgccgatcgacatgcgacggttgatgtccttgatctcggcgatcgtcaggccggtctcggtctcgagcgcggtcagcttctgctggcaacggatgatgtccggttgcaggcgaccgatggcttcggcgtacttggccttgcctttggccagtgcatcggaccagctttcgtccacttcattgccagggaactggcgcaggaagtcggcgcgtggcatgcgagcatcacgaacacagagttgcatgatcgcgcgctcttgctgacgcaggcgatccagggcgctacgaacgcgttcaaccaggccttcgaattgcttcggaaccagtttgatcggcatgaacagttcagccagggccagcatttcagccagggcttgcttgtgttcacgaccgtgctttttcagcgccttgcgagtgatttccatctggtcggcaacggcgccaaagcgctgggctgcgatgaccggatccggaccgctttcggcttcttcttcgtcgtcactggcttcggcgtcatcgtcgtcggtgtcgtcgtccgctttcgcggccttggcatcgacaggcggtggtacttcggcggcaggcggcgcgatgccgtcgtccgggtcgatgtaaccgctcaggacgtcggacaggcgaccaccttcggtggtgacgcgagtgtattcggagaggatgtgctcaaccgtgccagggaagtgcgcgatcgcgcccatcacttcacggatgccctcttcgatacgcttggcgatttcgatttcgccttcacgtgtgagcagctctaccgtacccatttcgcgcatgtacatacgcactgggtcggtagtgcgaccaatgtcggtttccacagccgccaacgctgcggcggcttcttcagctgctgcttcgtcggtatcggcttcggccaacaaaagggcatccgcatccggagcactctcgaatacgttgatccccatgtcgttgatcatgcggatgatgtcttccacctgttccggatctgaaatatcctccggcaggtggtcgttgacctccgcgtaagtcaggtaaccctgctcacgaccacggctgatcaactctttgaggcgagactgctgttgcgcttttccggacataacaccctatccactgaaggtcttggcgggcaaaaaacaagccgaggattatacccgagctatgacctcacgcgccagttgaggtcgggtttgatgcgggaacattgcgttttaaaagctcaagtagctgaattttttcttcgccactcaattcgctttgacgcgatttcctgagaagttgttccaaagcacgctcactttggcgagcggacaagcttttaatggtgtcgaaaaactgttgttcaaggttatcgccctcaatcaaccattccttttctgccaacgccttgatcaggcggccctgctccgtgccgtgccagcgcgccatcagttgatgaatagagcgtagcttaggatttttctgcacggcttcgatcagggcgaccagcaactgggtattggtgttgtcgtcggcggcgaaatgcccggcgtcttcaactttctcggccagttgcgggtgatgcagcaatgttcgaagggctgacagtgtaggaggttcgacggcggccggaacgcgcggggcacgtggttgatcacgatcgccattacgcttgccctttttgtcccaaggcttgttctcccacttcttgccgccggcaccgcttttcttcggcgtccactcctgctgcggcacataggcctcttgcggctcgtggtagtcggcatagtccggcatggcgtcgtaatcgatgccggcgtcgtacgccggcggcgcttcttgtggggcgctgtgcaccaactggttgacggtctcgttgttgagcccggtaatttcactgaggcgctggcgcatcagggtccgcaggttggctccggggaccttgtcgatcaacggtgcagccagggtggccaggtgggccttgccctcgagcgagcgtggatcggcttcgtccgtcagttgctggaagaagtaatcggccagcggttgagcgtgttgattgatgcgtgcgcgaaaggcgtcggtgccttcggagcggaccagggtatccggatcttccccttcgggaagaaacagaaaacgcgcccggcgaccgtcctgcaggctggacagggtcgcctccagcgcgcgccaggcggccttgcgcccggcctggtcgccgtcgaaacagaacaggacgctgggtacgatgcggaacaggcgcttgaggtgttcttcgctggtggcggtacccagggtcgcaacggcgttacgcaggccttgttgggcgagggcaatcacgtccatgtagccttcgacgacgatgatttcgtcgaggttgcggttgttcttgcgggcttcgaacaggccgtaaagctcctgccccttgtgaaaaaccggtgtttccggcgagttcaggtacttcggtttgtcgtcgcccagtactcggccaccaaaggcgatgatccggccgcggctgtcgcggatcggaaacatcacccggtcgcgaaagcgatcgtagcgtttgccggtttcggcattttcgatcagcaggccggcgtcgatcatggctttctgctgcagggtgtcgctgctcaggtgcttgaacaggttgtcccagccgggcggtgcaaagccgaggccgaagtcgcgggcgatttcgccggtcaggccgcgccccttgaggtagtcgaccgcggccttgcgggccggatggcttttcagggcctggcgatagtaatcggcggcggcggtcagcagcggatagagcggcgagtcggttggctgccggggcttgtgcgggcggccgctttcctcgcgcgggatctccatgccggcggctttggccagttcctcgactgcctgggggaagtccaggttgtcgtggtccatgatgaagccgagggcgttgccgcccgcgccacagccgaagcagtagtagaactgcttgtcagggctgacgctgaaggagggggtcttttccttgtggaacgggcagcaggcggtgtagttcttgccggcctttttcatctgcaggcgcgagctgacaacatcgacgatgtcggtgcggttcagaaggtcgtcaataaagctctggggaatcagcccggccatggcgttctcgtcatcactgcgcgaaagaattggaccaatgcgaaggcttcgaaagtgggctgctcgagacgcaacggctgcgcgttcgaccatctgtcgtcggcttgatcgctatcgggaagtgtatctgccgaaagtccactgacgttagtttcaatcagtcttcgactatttgaagatattgctctgagtccgacaggtctcggatggctcataagcgggcgctggagaagggcgccttgggctgagtctgttgaggaatcagaataaaagtgtgctcgtcagtagccttggaaggctcgtcagaagagacgtgcaccgctggcaggaagccaggtctgacgtggtgaagcggattgtctcggtcgcatgcgcggcgttgacggtgaagcatcaagcgttgtccgcaaatgccattagcccggctgagggccgggcttggcagaagcttgcagcgaacgtctgtgtattagtacagacgtacggcgcggcgctgttcgcgctgaactttcttggcgtgacgcttaacagcagcagctgctttgcgcttacgctcggaagtcggcttctcgtaaaattcgcggctacgaacttcagccagaacaccggctttttcgcaggagcgcttgaaacgacgcagagctacgtcgaagggttcgttctctttaactttgacggctggcatccagagctaccttcattcattaccggggtcaacgttctcgtcgcaaaaatcgcggctgaggtcgtcggtttttaagggttgcggatgttaacccctcatcgctcggaatgcaaagcctctgatcgaaaaccgctggtcggctgagggagtggcgactattatgcgcgccttcgaatttagcctctacaaggcgcaaacccatgctagtactgggattagaaacttcctgcgacgaaaccggcgtcgcgctttacgacagcgagcggggcctgctggccgatgcgctgttcagtcagatcgacctgcatcgggcctacggtggcgtggtgccggagctggcctctcgcgaccatgtcaagcgcatgctgccgctgattcgccaagttctggccgaggcggactgtgtgccgaccgaaatcgacgccattgcctataccgctggcccgggtctggtcggagcccttctggtgggcgcttcctgtgcgcaggcgctggcctttgcctggggtatcccggcgctgggtgtgcaccatatggaaggccacctgctggccccgatgctggaagaacaaccgccggaatttccgttcgtcgctttgttggtttccggtggacatacgcagctggtgcgggtcgatggcatcggccaatacgagctgatgggcgaaaccctggatgatgctgccggtgaagccttcgacaagacggcgaagatgatcggcctgaattatccgggcggtccggaaatcgctcgcctggccgcacaaggcgtggccgggcgctttgttttcccgcggccgatgaccgatcgtccagggctggatttcagtttcagtggcttgaaaacctttgccctgaatacctggcagcaatgtgtcagcgctggggacgacggcgaacaaacccgttgcgacatctcgctcgccttccagcaggcggtggtggaaactctgaccatcaaatgcaagcgagccttgaagcaggccggactcaagcgtctggtcattgctggtggcgtgagcgccaacaaggctctgcgcgcgtcgctggaaaaaatgctcggcgagatgaaggggaatgtgttttacgcccgtcctgagttctgtaccgataacggcgcgatgatcgcgtttgccggttgccagcgtttgcaggccggtcagcaggagagcctggcgatcagtgtgcaggcgcgttggccgatggagcagttgtcgccgttgtgagtcggtaatttcccgacctgagcccggttcatcttcaggattcagaaatgccgttcgcgcccggcaaacaggtcgcgtagattgccgcggtggcgccagacgatgagcagtgtgagcacgctcatcggcagtagcgccgccggcgcctgccaggccagcaatggcagggtcaggggcgtggcgatcaaggccgccagcgagctggtgcgggtcaggtagaaggtcaggagccaggcggcaatggccaggagcgccgctggcggataaagccccagcagcatcccggcggcggtggcgacacccttgccgccgcgaaagcgaaagtacaccggaaacagatggcccagtacggcgtagagtccgatccaggcctgttgttggagcgaaaggcctgcgagactggcgatcagcacgggcaacagccctttgagcagatcgccgagcaaggtcagtaccgcaagtttcttgccggccaggcgcaacatgttggtggcgccggcattgcccgaaccactcattcgcggatcgggtttaccggtcaggcggctgagcaagatagcgaaggacagcgagccgagcaggtaggcgaagatcgccagtaaccaaaacatgctaactattccgggcgaggacgccctgattctaacggcgcattgcgcccttgtcgtgctgcggagaagagtgcttggacagagtgtttatcgagggtctggaagtcgacacggtgatcggtgcctacgactgggagcgaggcatccgacagtgcctgcgccttgacctgagcttcgcctgggacaaccgcccggccgcggctggtgacgacctgaccctggcgctggactacgccagcgtgtcttcgcggatccaggcgtttgctgaacaggcgcaattccagctggtggaaacgtttgccgagcgtctggctgaagtcctgatgagcgagttccatattccctggttgcacctcaagctgaccaaacccggtgctgttgcggccgccaaaggtgtgggcgtggagatcgagcgcggatgtcgctaactcaggtatttcttgggctcggcagcaatatcgagcgcgaaacccatctgctggccgggctcgatgccctggcgggcttcctgcaggacatgcgctgctcggcagtgttcgaaagccagccggttgggatcaagagcgggcctttcttcaatctggtggtttcggcctttaccgatctgccactgatggaactggatcgtcggttgaagttcatcgaagcggacaacggtcgttatgccccggaccgcaagggcctgccgctggatatcgatgtgctgctgtacggcgatctggtgggcaatttcgacggcttgatcctgccgcgcgccgagattctgaagaatgcctttgtgctctggcccttgtcgctgatggcgccggaaagggttcatccgctggccggacaggacttcgccactctctggcgcgaagcccaaatcgaccaggtgctggcgcccgtggcctttgagtggaggggcaggcagctgacgccaccggagctgggatagctctggctgattgctatcggcttgcgagcaagctagctcctacagtggagctagcttgtgatgtttcttaccgcgggtgctgttccttgtaggccttcagcgccttcagtcgctcccgtttcagcgcctctcccaactccggccccttgaatccctgctccagcagcggctgcaccgctaccgttcgtgctgcggtggccgcgccgcgcaaatagtccgcctggggataggcgcgctcctccaatccgagacgaccgcgagcatccatttcacaggcggcgataaactcctcgaaacgctgcggccgacggtacacgtcaaagctttgcagcagctgcgccaatgtcgaaggtttcagttcgagggcgcgatggccatgggtgtggtactgacccaccagcagcgccagttcctggcagtcgcgcggcgccttgaagcgttcgttgacgcacttgatcagcttcaggcccttgtgctcgtgtgcgatgtgctgtggccattcactttgcggtgtcaggcccttgcccaggtcgtgcaacaggcacgcccagcgcacgctcaatggctgcttgtgccgtgccgcttgctcgagaacgctcagtgtgtgcacaccgctgtcgatctccgggtgatgggcggcgggttgcggaacgccaaacagcgcctccacttcgggcagcaggaccttgagtgcgccacagtcgcgcagcacctggatgaacacttgggggtgatcttccatcagtgcgcgggagatttccttccagctgcgctccggcgtcagggcttccagttcgcctgattcgctgagctggcgcatcaattcgagggtgtcaggcgctacccggaaaccgagcccagcgtagcgagcagcaaagcgggcaacgcgcaggacacgcagcggatcttcggcgaatgcgggggaaacgtggcggagtaggcggttctccagatcctgctggccgtgatatggatccgtcagcacgccatggtcgtcttccgccatggcgttgattgtcaggtcgcggcggatcaggtcttcttcgagggtgacttcggggctggcgtgaaaggtgaagccgccataaccccgaccgcttttgcgttcggtgcgggccagggcgtattcctcgccgctcttggggtgaagaaagaccggaaagtccgagcctaccggccgaaagccgttggcgagcatttcttcggccgtggcaccgactaccacccagtcgatgtcggttaccggtttgcccagcaggcgatcgcgtactgcaccgccgaccttgtaaatctgcataaaaaacctccgttagcccgacagaataacccttgcgccgagctttcggaggtttgtcatgcgctcagaggtggatgacagccaggtccaggcggccatagtccccttcgttgtgatcgcttcttggcggtacgtgatgggttttcatcacctggtcgccctgcagggtttccagatggatgtcgaatccccatagccggtgcaggtgcttgaggacttcgtcggtggagtcacccaatggtttgcggtcgtgctgttggtggcgcagggtcagcgagcggtcgccccgtctatcgatgctccagatctgcacgttgggctcgcggttacccaggttgtactgggctgcaagggtttcgcggatgactcgatagccgctttcgtcatgaatggccggtaccagcaagtcgtctttctggtcgtcgtccaggatgctgaacagcttgagatcgcggatcaccttgggcgacaggtactgcaggatgaaactctcgtccttgaagctgctcatggcgaacttgatgctggaaagccagtcggtcccggccagttccgggaaccagcgacggtcttcctcagtcggttcttcgcagatgcgccggatatcgcggtacatggcgaaaccgagggtgtaggggttgatgccgttgtagtaagggctgtcgaagccaggctggaagaccacgctggtgtgggaggcgaggaactccatcatgaagccgtcggtcaccaggccttcgtcatacaggtcgttcatcagggtgtagtgccagaatgttgcccagccttcgttcatcacctgagtctggcgttgcgggtagaagtactgggcgatcttgcgcacgatccgcacgatttcccgctgccacggttccagcaacggcgcgtgtttctcgatgaagtacaggatgttttcctgcggctcggcggggaagcgcgcgttgtccttgtcgctgaacttgtccgtgcctttgggaatggtgcgccacaggtcgttgatctgtttctgcaggtgttcttcccggtccttttgccggcgtcgttcttcttccgcggaaatcggataaggacgtttgtagcggtccaccccgtagttcatcagggcatggcaggagtccagcaggtcctccacggcatcgatgccgtggcgctcttcgcactgcatgatgtactgcttggcgaacaccaggtaatcgatgatcgaactggcatccgtccaggtgcggaacagatagttgcccttgaagaagctgttatggccatagcaggcatgggccaccaccagtgcctgcatgcagatggtgttttcttccatcaggtaggcaatgcatgggtctgagttgatcacgatctcgtaggccagccccatctggccgcggctgtaggacttttcggtgctaaggaagtgcttgccgtaagaccaatggtgataacccaggggcatgccgacagaggcataggcatccatcatctgttcggcggtgatcacttcgatctggttgggataggtatccagggcgtaacgcgccgcgatacggctgatttcgcggtcgtaggcctggatcagctcgaacgtccattccgaaccggtggagataggttggcgtttctgctctctggcggtcatgtcactaacctgcgctggaagagttcacggaagaccggatagatatctccggccgagaccagttgctgctgggcgaaagtatcggaaaaggcttcggcgatgcgctcgtattcgaaccacagggcctgatgttcgcgcggggtaatctccacgtaagtgtagtactgcacgaaaggcatgatctggttgatcaggatgtcgcggcagatcggcgagtcgtcgttccagttgtcgccatcggaagcctgggcggcgtagatgttccactcgttgctcggatagcgctcggccatgatctcctgcatcagtttcaaggcgctggagacgatggtgccaccggtttcccgggagtagaagaattcctcctcgtccacttcacgcgcactggtgtggtggcgaatgaacactacgtcgatcttgtcgtagttacgcttgagaaacaggtacagaaggatgaagaagcgcttggcgatgtccttggtggcctgggtcatggagccggaaacgtccatcaggcaaaacatcacggccttggagctggggttgggctgtttgaccagcagattgtacttgaggtcgaaggtgtcgaggaacggcacccgatggatacgggcgctgagacgctcgatttccgcttccatttcctgaatatcgccgaagttgtccggttcttcgcgtttcaggcgttcaagttcctctttgacttcgcgcagttttgcccggctgctgccggacagggcgatgcgccgggcatgggccgagcgcagggttcgaatgatgttgatgcgcgagggattgccttcgttgctgatcccggcccggacggttttgaaggtgtcggtcccgctcaggttgcgtttgaccaggttcggcagttccaggtcttcgaacatgaactcgaggaattcttcctgggtaatctggaaaacgaactcgtccatgccttcgccggaattgccggccttgccacggccacctccgccgccaccgccttgagggcgtgcgatgtgctcgccggccgtgaactccttgtttcccgggtgcaccacggtctgtttgccgccgcgcccatgatggagcaccggttcatcgatatcccggcctggaatgctgatttgttcgccatgctccatgtcagtgatggaacggcggctgaccgcctcttcgacggccttcttgatgtggtcacgataacgccgcagaaaccgctgacggtttaccgtgcttttgttcttgccattgagacgtcggtcgatcacataactcatgactgctccttagaagcggtcttgaagctcgcaagcggcccggacggggggagggggcggcaaggtgtcttgccgtcggtcctctgcccgagcctcgctgcgaacgttcaaacgcgcttcctgaagcctgtgtagcagaaatcgctaagacaggctcctggctaacgacaaccggtgcaaccggcgggttactgcgattttctgacccgcagataccactcggacagcagtcgtacctgtttgtcggtgtagccgcgctcgaccattcgggtaacaaagtcgttgtgtttctgttgatcctctttgctggccttggcattgaagctgatgaccgggagcaggtcctcggtgttggagaacattttcttctcgatgaccacccgcagtttttcgtagctgagccaggtcgggttcttgccgttgttgttggctcgggcccgcaatacgaaattgacgatttcgttgcggaaatccttcggattgctgatgccggccggtttctcgattttttccagctcttcgttgagcgcgacccgattgaggatctcgccggtttccggatcgcggtattcctgatcctgaatccagaagtccgcatacagcacatagcggtcgaagatgttctggccgtattcgctgtaggactccaggtacgccgtctggatttccttgccgatgaactcgatataccgcggagccaggtattccttcaggaagcgcaggtagcgttcgcgggtttccgcctggaactgttcctgttcgatctgttgttcgagcacataaagcaggtgcaccgggttcgccgcgatctcgtggggatcgaagttgaagactttcgacagaatcttgaaggcgaagcgggtcgacagaccgttcatgccttcatccacgccggcggcgtcgcggtattcctggatcgacttggctttcggatcggtgtccttgaggttctcgccgtcgtagacgcgcattttcgagtagatgttcgagttctccggctccttgaggcgcgagagcacggtgaactgagcgagcattttcagggtgtcgggagcgcaatgcgccttggacagggagctgttgaacagcagcttgtcgtagattttgacttcgtcgctgacccgcaggcagtacgggactttgacgatgtagatccggtcgatgaaggcttcgttgttcttgttgttacggaaggtgtgccattccgattcgttggagtgggccagcaggatgccggtaaaggggatcgcgcccagcccctcggtactgttgtagttgccttcctgggtggccgtcagcaatgggtgcagcaccttgatcggtgccttgaacatttcgacgaactccatcaggccctggttggcccggcacagtgcgcccgaatagctgtaggcgtcggcgtcgttctgcgggaattcctccagcttgcgaatatcgaccttgcccaccagtgcggaaatgtcctggttgttctcgtcccccggttcggtcttggcgacggcgatctggttgaggatcgagggatagagtttgaccactcggaactggctgatgtcgccaccgaactcggacaggcgcttggtggcccaaggcgacatgatggtgttcaggtagcgccgtgggataccgaagtcttcttcgaggatcgcgccatcttccgtggcgttgaacaacccaagaggcgactcgaataccggagagcccttgatggcgtagaagggcaccttttcgatcagttgtttgagtttctcggccagggatgatttaccgccaccgacggggccgaggaggtagaggatctgtttcttctcttccaggccctgagcggcatggcggaagtaggagacgatctggtcgatgcattcttccattccatggaagtcttcaaaggccggatagcgacggatcactttgttggagaagatccgtgacagtctcgaattggtcgacgtgtccagcagctccggttcgccgatagccagaagcaggcgttcagcggccgacgcgtaggcgctacggtcctttttgcagagctccaggtactcctgtagcgagaactcttcctggcgtgtggattcgaagcgttgttggaagtggctaaaaatactcatgacgtcacctcgctcgatacgtggagccgacgccggatcagtcagtcaagtgctggcatgcagccgggaatccggctgatgtttaccccccagaacactttcaaagctatcgaccttgaaagctagtaccgatgacccgcacgccggtgtaccggctctcccctgattggatggcctgaggctaaggatagttcggaatcggggaggtaaaggtggaatacgcaatttgttcaagtgaccgttcgtcggtcatggcgccagcccgcgaatgacgcgggctggcgcgcagaaaaattattcggcgctgccctgggcaatttccgcagggtaggtggtccgccacaattcgaaaccaccgtccaggctgtagacgttggagaagccctggctgatcaggtaggccgccgcgctttggctggagttgccgtgatagcagacgaccaccagcggggcgtcgagatcggcgttgcggatgaagtcggagatggagtggttgtccaggtgcagggagccgctgatgtggttcagggcaaaggtctgcgggtcgcggatatcgaccaccacggcgccttgctcgcgcagtgcctgggcctgttctggggggatgcgtttgaattcgctcatggcgggctcctgggcctggtggcaagcgccgtctagcgcttggcggtgattggtgtgggttcaggggagggttgatgggcctggggcttgatgtggccgtgggcgtcgcactcacactcgaggcgttggccggtgtcgacgttcagcaaggtcagggctccgccccagacgcagccagtgtccagggcgacgacgccgggctggttgcagttgccttcgagggcggcccagtgaccgaagatgattttcacgtcccgggtcttgcgttccttgtgctcgaaccacggcgcgtaccccggtggggcggtgtccggcccttccttgcccttgaggtcgagcttgccatcgctggtgcagaaacgcatgcgggtgaaatagttggtgatcacccgcagacgggtcacgcctttgagttcgctgtcccattttgtcgggtcgttgccgtacataccgtccagatagggctcgaagcggttgtcgtcccgcagcgcctcttcgacttcggtggcgcacttgagggcttttttcagcgaccactgtggcggtatccccgcatgcaccagggcgacgttgcgctgttcgtcatagtgcatcagcttttgctggcgcagccactggagcaactcctcgcaatccggcgcgttgaggatctcgcgcagggtgtcggctttcttcaggcgctcgatattgcgccagacggccagcaggtgcaggtcgtgattgcccagtacgcagaccagggtgtcgcgcatggcataaagaaagcgcagggtttccagcgactgggggccgcggttgaccaggtcgccgaccagccacaggcgatccttggtcgggtcgaaggcgaccttttcaagcaggcactgcaatggccccaggcagccttgcaggtcgccgacggcgtaagtcgtcatcagtgcagggctccgggcacggccaggcggaagggggcgatgatggcgtcgaagtgtttgccgtcttcggcgagcatctgatagctgccctgcatattgccgacgcgtgtggtcatgaccgtgccactgctgtaggtgtggcttttgcccacggcgatcagcggttgctggccgacgacgccggcgccgcgaacttcctcgacgtgcccgtcgccatcggtgatcacccagtgccgcgagagcagtttggctggcagcaggccattgttctgtacagtgatggtgtaggcgaaggcaaagcggttctgctcgggttgcgactgttctgcgagaaaacgggtgacgacgctgacgtcgatctgatagcggggatcggacatgcaaggggccttaaaacgaagcggggcgcgggacaaagctgatggaggtcagtctaggccaagtatcgggtagtaaaccagacatggagcctggcgtcttacccgataacgctggtggcgtgtcagcttgcgctggcggtgtccgcggcttgttcgctgagcttgtcggccaggcgaacgaaggctgccaggtccagttgctccggacgcaggctgccatcgacgccggcggcttcgatctcggcgcttgtgagcagggccttgagggtattgcgcagggtcttgcgacgctggttgaaggcttcgcggacgatgcgttccaacaggcgatgatccttggccggatgcggcagcacggcgtgtggcaccaggcggacgattgccgagtcgacttttggtggcggattgaacgcgccagggccgacgttgaacagatgctccacgcggcagtggtactggaccatgatcgacaggcggccccagtcgccaccgcccgggcccgcggcgaggcgctcgaccacttctttctgcagcatgaagtgcatgtcgcggatcagtccggcgttctgcagcaggtgaaagatcagcggggtggagatgttgtagggcaggttgccaaccacccgcaggctgccgggcgcggcattcaggctgttgaagtcgaacttcagggcatcgccctggtgcaggctgaaattatcccggccagcaaactgctggttgagaatcggcaccaggtctttgtccagttcgaccacatccagctgggcgccgctgttgagcaggccctcggtcaaggcgccctggcccgggccgatttccagcatgcggtcgccggatttggcattgatggagcgcaggatgcggtcgatcacgccggcgtcatgcaggaagttctggccgaagcgcttgcgcgcccggtgttggtattgctcggtcataaacgggtctcggccatctggtaggcggtttccagggcgactttcaggctgccggtatcgatcttgccgcttccggccaaatccagggcagtgccgtggtcgaccgaggtgcggatgatcggcaagcccaacgtcacgttgaccgcggcgccgaagcctttgtatttcagcacgggcagcccctggtcgtggtacatcgctagcactgcgtcgcagtgctccagatatttgggggtaaacagagtgtcggcgggcagggggccacgcaggtccatgccttcgttgcgcagacgctccagggtgggttcgatgatatcgatttcttcatggcccagatgtccgccttcgccggcatgcgggttgagcccgcagaccaggatgcgtggctgggcgatgccgaatttgttgtgcaggtccgcatgcagaatgcgcgtaacccgctccaggcgctccgtggtaatggcgtcggcgatgtcccgtagtggcaggtgagtggtcaccagtgccacgcgcaggccatgggtggccagcatcatcaccacttgttcggtgtgcgtcaggtcggcgagaaactcggtatggccggaaaaggcaatgccggcttcgttgatcacacccttgtggaccggggcggtaatcatgccgtcgaaatgcccgtccaggcagccttggccggcccggatcagggtttccagcacgaacgcggcgttggccctgtcgagctggccggtgacgactttggtcgccaacggggtatcccagacgtagaggctaccggcggcggccggctggtttggccagttgtcggggccgaccgcaatcaggctgacggccacacccagctgcgcggcccgctcggtaagcaggtcgcagctggtgatggcgatcagggggtatggctgttgttgcgaagcgagcaacaggcacaggtcgggacctatgccggctggctcgccgggggtgagcgcgaaacgcttgggtttcactgtgccgcctggtcagcgccaggaagtttgatctcgacgtaggcttcatcgcgaatctggcgcagccaggtttgcagctcttcgtcgtatttacggttgcgcagcacggtcatcgcttgctgttcgcgggcctggctggtgctgtcagtggcgcggcggccaaggacttccaatacgtgccagccatatgggctctggaacggcttggacagctgaccttgcggggtcttggccatcacgtcgcggaactcgggaaccagggcgttcggatcgatccagctgaggtcgccgccattgagggcggaacccgggtcttccgagtagcttttcgccagttcggcaaagtcttcgccggcttcgatgcgctcgtagagcttctgggccaggcgcttggtttcttcttcgctgcgaatttcacttggcttgatcaggatatgacggacatgcacttcgtcacgcatctgattgccgccgccgcgtttttccaacagcttcaggatgatgaagccgcctggagtacgagctggctgggtgatatcgcccactgccatggcgctcagttcgcggtcgaacggagggggcagttgagcggctttacgccagcccatgtcgccgccttccagagcgttgtcgctgccggagcgggcgatggccaactgagcgaagtcggcgccttgcttgagctgctggtagatgtccatggcctggcgcgcggcgctctgaatcgcttcggagttggcgctttccggggtgggaatcaggatattggccaggtgcagctcttcggacagttgcatcttacccaggtcggaggcgaggaagtttttcacttcctgctcggagacctgaatgcgttcggcaacacggcgctgacgtacgcgactgatgatcatctcgcggcgaatctgctcacgggcgtcctgataggacaggccatcacgcgccagggcggcgcggaactgatcgggcgtcatgttattgcgttgggcgatggtaccgacggcctggttcagctcttcatcggtaatgcggatgccggagcgttcgccgatctgcagttgcaggttttcgacgatcaggcgttccagtacctgctggttcaggacctcggcgggaggcatgccgccgccgcgcttggcgatggtttgctgaacttcgtgaacccgttggtccagctggctttgcatgaccacgtcgttatcgacgatggccaccactttgtcgatgggttgtaccgcggcgctcgccgcggtacccaggaacagcgcgcccagcatcagcgggcgcagacaatcagaaagcttggtcttcacgttcacggtaaccttgaatgcctttgtcgaggaagctctctaccttggcgccggtaaggccgccgagtcctttcaggacgatttggaggaagatgccatggtcgcctttctcgttctgcggggcgtcttgactggtctcgtcatacttgacccagtaacggttgatcaggcgcagtttccagcagcagttgtcgtattcgaacccaccgaaggcatcgagggtacgattgcggttgtagtcgtactgccagcggctgatcaggttccattgcggcacgatcggccagatcaccgagaagtcgtgctgcttgatcttgtaatagtccttcacgtagccaggagtgcctggggtgccgtagtcaccgccacccaccgaccatttacctgtggactggtcgtaacgaaccaggtcgttgcgataacgataaccggcgttgatgaccttgttcgggttgtcttccggctggtagtggaacatcgcgctaccggagcgaggactgcgggtatctggatcccagttgtagtcggcagtggtgcgccagtcgcggttccagcggtactcgtattccagtgcataaggcgaaacgttggagtgcgcgtcgtcgcgggttttcgcatcgatacctggcaactggacttcgcggtccttgaagtacagggcctggccgacgctgatgcgttgacgttcgaagccgttttcttcgatccagcggttggtaacgccgagagacagcttgttctcgtcacctacgcggtctgagccggagaagcggttatcacggaacagtgatgagtaattaaaggtggattcgctggtatcgaataccgggatatcgctctgatctttctctggtacatagagatagtacaggcgtggctccaaggtctgacgatagtttttgccgaaccattgagtgttgcggtcgaagtacaggccgctatcgatgctggcgataggcacgccacggttctggttgctgctgtaagtaccgttcaggcgatcttgttccgcggtttgtgccgcaacctgactcttgccgatgctgtccagatccagatcgtactgggtgtactggtacttgagggacggtttcaggaaaccgtaggtccaattgagtgggagacttacagttggcgcgaggttgaggcgattgccattggcgcgagccaaacctgtgatattgcggtcgagtcgtggcgagccaataccattttcatcaaagtacgtaccgttttgcaggtcgcgatcaaatcgaactatttctgcgtcgtacctgaagtccaagccacccggatgctgcggcaagaaaccattcaaggtgatctgtggcaagcggttgtaaggcgtgatgttggaaaccgtggccagttcataagcctgggcattgaggcgcgcggtgtaggtatcgccgcggtaggtcactgcaccctgctggttaatgtaatcacgactttccacgccgatctggtcgctctgcagatcctggaagtagtacggatcgctgatcttggtgtagtcgacctcggtcattacccgcgaatcgagtccgcccttgtgctgccagttgtacatgtagcgggtcttttcgtagtccgtctgcagcttgcggtcgtcgttgtcgtcgttgaggtacgccgcgccgaactgaccttcgctggacttggtcaggtagcggaattcgccttccatcaacaggccacgcttgctcatgtagcgcgggtacaacgtggcgtcgtagttcggcgccaggttgaagtagtacggggtgaccagcatgaagccggtatcgctgccgctgccgatggtcggcggcaggaagccggactggcgacggtcgtcgatcgggaaatagatgtacggcgtgtacaggaccggaatgtccttgacgcgcaacgtcacgttggtcgcggtgccgaagccggtcgccgggttcagggtgatgttgttgcccttgagctgccaggcgttgctgctcggttcgcacgtggtgtaggtaccatccttgaggcggatgatcgcgttctcggcacgcttggcgtacagcgcgttaccgcggatgcgcgatttgtgcatcacgtattcggcgttgtcgaccttggcctcgccggtgtccagctgcacgtcggcgtgatcgccgaccagcagggcgccgttgtcgcgcaggcggacgttgccgttcagctcgccacgattttcggcctggtataggttggcctcgtcggcctcgacctgcatgctgccctggcgcatgaccacatcaccggccagggtggcgatctgctgctcctgctggtaacgcgaagccttggcgccgataaaggtcggggcgtcacttttattcgtcttgtcattcatgccaggacgaatcggttcgatataagcaccagcacagtaaggaccggtctcggccaactgggcggcggtgagcttctcgcgcggaacccagtcgaggtgactgtagtcttcgctgcgggacttcaggccgcggcccttggactcggtaaccagcatcggcttggcgccggtgtcttcgctggtttcgccgccttcggccgatgcagcggtgctcgagctgaccgcactcgcgtcatgcacggggcgcggaggcagttgagcggcgctggttttcggcgcgcagtcccagccacccgaagcagagactgagcagtcatactgttctgcggcgaccacgaacgaagtggctaggggttgcagggccagcagactgccagtaaccaacaacggaaattttttacgaaacgcgggggatttcaatgccatcttattagtccgggcttcctgcgtgccatctgcccgcggtgtgggccgcacgcctctcgatggtctgaaaaagatgctggataataaagcatgacccgcttgacggctagcgccgtcggagacccttgcaatgcctgaccaagatgtacgcttgcaacacctgaaagtttggctcgatgagcagttgtcgattgtttatgcctccaacggatggggccccgtgcccccggccacattgaccgcggccagcagcgacgcgagtttccggcggtatttccgctgggaaggcgaaggccgcagctttgtcgtgatggatgctccgccgccccaggaaaactgcaaacccttcgtggatatcgcccatttgttggcaaaatccgcaaccaatgtgccgaaaatttatgcagaagatttgccgcgcggctttcttttgctcaatgacctgggcaacaaaacctatctggacgtgatcgacggcgaaaatgccgacgccctgttcaaggatgcgctgcaaaccttgctggctttccagcagttgccgatggatgcgccgttgcccagttatgacgtcgctttgctgcgccgtgagctggaactgttccccgagtggtacgtggggcgcgagctgggcgtcgagttgaatgagcgccagcgcggccaatggcagcgggtcagcgagctgctgatcgagagcgccctggcccagcccaaggtgctggtgcatcgtgactatatgccgcgcaacctgatgctcagcgaacccaatccgggcgtgctggatttccaggacgcggtctatggcccggtgacctatgacgtcacctgcctgttcaaggatgcctttctcagctggcccgaagcacgggtgcgcggctggctggaagactactggcagcaagcgtcccggctggggatcgcggtacagcccgacttcgaggatttcctgcgcgccagcgacctgatgggtgtgcaacgccatctcaaggtgatcgggatcttcgcgcggatctgccaccgcgacggcaagccccgttacctgggcgacgtgccgcgtttcttcgcttatatagaggccgtcctggctcgtcggccggagctggcggagttgggcgaactgttggccagcctgcgtcaaccggtcggagcctgtgtatgaaggcaatgattctggccgcgggcaagggcgaacggatgcgccccttgaccctgaccacgcccaagccattgatccgcgccgccggtgtgccgctgatcgagtaccacctgcgggcactggcccgggcgggctttaccgaaatcgtcatcaaccacgcctggctggggcagcagatcgaagatcatctgggcgatggctcgcgctttggcttgagcatccgttattcgccggagggcgagccgctggagaccggcggtggtattttccgcgccttgcccttgctgggcgacgagccctttgtggtggtcaatggcgatgtctggaccgattacgatttccgctcgttgaaccgtccgctggatgcgttggcgcatctggtgctggtggataacccggctcatcacaccgccggggatttcatcctcagcgatgcccgggtgcgggacgccgagccgggtgcgcagaccctgacctacagcggcatcgcggtgttgcacccggacctgttccagggctgcacaccgggtgcgttcaaactggcgcccctgttgcgcaaggccatggccgatggacaggtcagcggcgagcgtttgcagggacactgggtcgatgtcggcacccatgagcgcctggcggaagtcgaaaccttgttagaagcgagtcgttgatatgttgtggccggggactctgatcggagccggggctggctttgccatagccagtatcccgggggccatgctgggagcgttgctgggacaggcgctggaccggcgtttgcaattgcatagctgggcccaggtgcgtgagcgtctgggcggtcgaccggcgctgcgcaacgatgaactgctgttcgtgctcttggggcggttggcgaaaagcgatggccgggtggtcgatgggcatatccagcaggcacgtctggaaatgcgttcgctggacatgagcgaagccgcgcagcgccgcgccattgccgcgttcaatcggggcaagtcgggtaacgatcggctacgaggctacctgcggcgcctggcgacgcagccccatgctgccgagggtgtgttgcgcgcttgctggcggatggtctgggccgatggccgggccagcgtcgccgagcgcgagctgatccagctctggggcaagtggctgggctggactgtgcagcaggtgcaggcgttggcggcggactacgagccgggtaaaaaaccgttggccaacagcagtggcacctatcaggacgcgttgcgcctgctgggtgtctcggcgaccagcgagccgtcgcagatcaagcgcgcctaccggcgcctgctcagtcgccatcacccggacaagattgccggcagcggcgcaagccccttgcaggtgcgtgaagccacggagaaaacccgcgagctgcacagcgcttacgcactgatccgcgagcgccgggactttcgttagagagactcgttagagagattcgttagagggaaatgccccacgcccggccccgtgccctgtcaaaaacaggagcgggaccgggcgcggctgggttcagtcttgcacgggttgcgggctcagccagccgcgtacgcgtctgaacagctgctcgttttcagccgtgctgttgcccggcagggcgttgagcgagacctgggtgaagttggcgttcttctggcgcttgctcgcctgcaggcgttccagggcgttcttgcgagcctgcgcgttgtccttgtagaaaaaatcggcggtcgccagcttcagggtcggcgtcagttccgccagtccgggtttgccgatggacggggtctgggcagccaccagcaccagtttttgaatctccggcggttgtttttcgctcaggtagcgcgtggcccagtaggcgccgctgccatggcccagcaacacaatgctgcgggcgttctgctgctgggcgtaggtcaccgcggcgtcgatacgggcaaaaatccgctcggcgtcggccttggcctgttcttcgctactctccaccaccgcgcgatcggcgatctcggcttcgccaccggcggcctgttcgattggcttgggcgctgccgtggcggcatctttgctgctagtgtcggcggtcgcgggcgcaggttcggcctcgacgatgcgtggttgcgccgcatcgctctgcaggtcgggcagggtcaggctcaggctgctccagtcggcatccggcaatctgttgcgcaaagggccgattgcctgaggccagtcggcggtttcgccagcgcccgggatgatgatcactgcgcctttgggatcgctggtgttggcgggtttccacagggccagaaagctctcgctgccggcttgcagtgactgttgttcgctggatggcaggacccgttcgagggctgcggcatcttcctggctacgctcaaggagcggctggcgttcggccggtttttccgcggcaggctgttctgccggggcggcttgcggatcggcggcctcgaccgaaaaggcacaaggcaggatcagcgacaggcacaatgcgggcagtgccgtgcggtggacaagggacatcggttattccaggccagaagtaatcccggcagcctaatgggttggtcagtatttgtcagtgtgtgagacttcagatgatgcgttttcgctgcctgttggttatcggctgtatctgccttcccttgatggcctgggcggtacccgcgccgcatatcgcccaggcgcagtggagccccgcgcagcagcagtggctggagcagcaccgggaactgcgggtcggcgtggtgctccaggccccctatgcccagtacgaccggcggctgcagcgcttgtccggcgccaatatcgaattgatgcagtggctggcccgggcgatgaaggtcgagctgagctggcgcaactttgccgatcaggcgcaactggaagcggcggtgcgcgccggtgaagtggatatggccccgggcctgagccagaccccggccggcctgcggctctggcagttttccgatccctatatgcgcgtgccgcaactggtggtcggcgagcagaaaggcgccggcgcggtggagctggaaaagctcgacagccagacccgcgtggcggtgcgcatgcccagcgcggtggcggactacctgcgggcgacctattccaacctcaatctgcagggcgtgcccctggagcgccaggccctgcaattgctgctcagccaacaggcgcgttatgcggtgatcgatgaagcacagctcagtcgcttgtcggcggaaccggagttcgccggcctggcggtggtaggcgatatcggattgccgcaactgctgcgggtggctacccggcgcgactggcccgagctggcggacatcgtgcagcgcgccttgcacggtatcgccgccaaggacctggagcagttgcacaatcgctggctgcaacccaagtatccgcggctgagcgagtcccgcggtttctggcagaacctcagcctgctgctggccgtgctgctgttggcgagcatggccatcgttatctggcagcgccgccagcaacagacgctcgagcagcgcctgctgaccacccgcgaggacctggcccggcgcgaggccagcgaagaagccttgcgtctgactcagttttccatcgaccagagcacggtgggcattctctgggtcaattgggacagccatgtgcgctacgccaatcgcgcggccgaaagcatgctgggctatgcgtcgggggcggtggtcgaccggccgttgagcgacttcgaacccaacctgcacatggaccgctggcttggcctgtggaagcgcgcccgggccagcgaggacgcgccgcccagcttcgagacccagtgtgtccgcgccgacggcagcatcctgccggccgatgtgtcgctgagttttctgcgctttcgcgatggcgagtacctggtggtttacctcacagacgtcaccgagcgtcgtcgcgccctggccgccctgcaggaaagcgaggcgcgattgcaggggatcgccgccaatgtgccagggctggtgttccgcctggagcgcgcgccggtgaccgggcggatcgatttcgcctacatcagcgaaggcagcgagagcctggtgggttattccccggcgaccctcagccatcgcgacatagggctgcgcagcctggtgcaccctggggaccgagccagttatcaccagacccaggaccacgccctggacaccgacagcgactggtcctggcaaggacggatcctgacccgccagggcgaacagcgctgggcggaaatcaaggccatcacccgccagcttgaggacggcgcctatgtctgggacggcatcgtctgggacatcagcgaaagcaagcgcatcgaactggaactggccagctcgcgggagcaactgcgcgagctgtcggcgcatctggaaagcgtgcgcgaagaggaaaaggcccgtatcgcccgggaagtgcatgacgagttggggcagatgctcacggtgctcaagctggagacctcgatgtgcgagctggcctacgcgcaactcgatccggggctgcacgaacgcttgaacagcatgaagcgcctgatcgcccagctgttccagctggtgcgcgatgtggccacggccttgcgcccgccgattctcgatgccgggatcgcgtcggccatcgagtggcaggcgcggcgtttcgaggcgcgcacgcagattccttgcctggtgcaggcgcccgacaatctgccggtgctcagcgacgccaaggccatcggtctgttccgcatcctccaggaggcgctgaccaacgtgatgcgccatgcacaggcgcatactgtcgaactgaccctgagtctcgagcagaaccaactgtgcatgaccatcagcgatgacggccagggtttcgtggtcgaggccgggcggccgacgtccttcggtctggtgggcatgcgcgagcgggtactgatcatgggcggcagcctgagcctggacagtcagctgggcgaaggcaccaccctgagcgtgactgtgccgctggacttgtaggcgcgagcaagctcgccgctgcagagatcatcactaataagaagaggtacgagctgtgatccgtgtactggtagccgaagaccacaccatcgttcgcgaaggcatcaagcagttgattggcctggccaaggacctgacggtggtgggggaggcgagcaatggcgagcagctattggaaaccctgcgccatgtgccttgcgaggtggtgctgttggatatttccatgcctggcgtcaacggcctggaggcgatcccgcggatccgcgcgctgaacaatccgccggcgatcctggtgctgtcgatgcacgacgaggcgcagatggcggcccgggcgctgaaggtgggggcggccggttatgccaccaaggacagcgacccggcgctgctgctgacggcgatccgcaaggtggcggcgggcgggcgttacatcgacccggaactggccgaccggatggtcttcgaagtcggcctgacggacacccgacccctgcattccctgctgtcggagcgcgagttttccgtgttcgaacggctggctcagggcgccaacgtcaacgatatcgcccaacagctggccttgagtagcaagaccatcagcacccacaaggcgcgattgatgcagaaactcaacatcacctccctggccgagctggtgaagtacgcgatggagcataagctgctctgagtggatctgtagccgctgccgcaggctgcgataggtccgcaggacctcgacggactcaaggccgcaggcgtcccttcgggccgatcgcagcctgcggcagcggctacacgtacccatttgcgacatgcaaacaggcttctggccatgatctgcgccgggcgtgcgccgggacttgtccaatcgcgccattcttgtagggggattcctacaatgaaccttccatccggctgaggccaatctctcataccccccgatttgcgcggcttgtggcctccactaggcttagtccacagccgtcaaaaaacaaaaggtgtgggtatgagcgaggtcgattcaagcgctgggacgagtgatgtactggtcagtttccgtggtgtgcaaaagagctacgacggcgaaaacctgatcgtcaaagacctcaacctggacattcgcaaaggcgagttccttaccctgctcgggccatccggctccggcaagaccaccagcctgatgatgctggccggcttcgagaccccgaccgccggggagatccagctggccgggcgggcgatcaacaacgtgccgccgcacaagcgcgatatcggcatggtgttccagaattacgcgctgttcccgcacatgaccgtggccgagaacctggcgttcccgctgtcggtgcgcggcctgagcaagaccgacatcagcgagcgggtcaagcgcgtgctgagcatggtccagctcgagtccttcgcccagcgttatccggcgcaactgtccggtggccagcagcagcgggtggccctggcccgggcgctggtgttcgagccgcagctggtactgatggacgaacccctcggcgcgctggacaaacagctgcgcgaacacatgcagatggaaatcaagcacctgcaccagcgccttggcgtgaccgtggtctacgtgacccacgaccagggcgaagccttgaccatgtccgaccgggtcgcggtgttccaccagggcgaaatccagcagatcgccccgcctcggaccctttacgaagagccgaagaacaccttcgtcgccaatttcatcggcgagaacaaccgcctcaacggccgcctgcacagccacagcggtgaccgctgcgtggtcgagctggggcgcggcgagaaggtcgaggcgctggcggtcaacgtcggcaaggccggcgagccggtgaccctgtcgattcgtccggagcgcgtgagcctcaacggctccagtgaaagctgtgtcaaccgcttctcagggagggtggcggaattcatctatctgggcgaccacgtccgggttcgcctggaagtctgtggcaagaccgacttcttcgtgaaacagccgattgccgagctcgatccggagctggcggtgggcgatgtggttccgcttggctggcaggtcgaacacgttcgcgcgctcgacccacttctagaggcgtattgatcgcccccttgcttcaccaaccctgcacgtggagagaacaataaatgttgagatccctgaaattcaccgctttgacattgggcctgatgggcgcatcgcacgcgatggcggcgggcccggacctgaccgtggtgtcctttggcggggcgaacaaggcggcccaggtcaaggccttctatgccccgtgggaagccgcgggcaacggcaagatcgtcgctggcgaatacaacggtgagatggccaaggtcaaagccatggtcgacaccaagagcgtgtcctgggacctggtggaagtcgagtcgccggagctgtcccgcggttgcgacgaagacatgttcgagcagctcgaccccgagctgttcggcaagcccgaggactacgtcaagggcgcgatccagccttgtggcgtgggtttcttcgtctggtcgaccgtcctggcctataacgccgacaagctgaagaccgcgccgaccagctgggcggatttttgggacaccaagaaattcccgggcaagcgcggcctgcgcaagggcgccaagtacaccctggaattcgccctgatggccgacggcgtcgcgcccaaggatgtgtacaaggtgctggccggcaaggacggccaggatcgtgccttcaagaagctcgatgaactcaagccgagcatccagtggtgggaagccggcgcccagccgccgcagtacctggcttccggtgacgtggtcatgagctcggcctacaacggccggatcgccgcggtacagaaggaaagcaacctgaaagtcgtgtggaacggcggcatctacgacttcgacgcctgggccattccgaagggcttggataagacccgtgccgaagcggcgaagaaattcatcgccttctcggtgcagccgcagcagcagaagacctactcggaaaacatcgcctacggtccggccaacacccaggcggtaccgctgctggccaaggacatcctgaaagacatgccgaccaccccggaaaacatcgccaaccaggtgcagatcgacgtcagcttctgggctgacaacggtgagcaactggaacagcgtttcaactcgtgggcggccaagtaaggcgtcatgcatgggcggcgtcacccgcgggtgacgccgttaccgtttaaagatttgcggagttcgtcatggccattagcgttcccctgaacgaggtcaccagccccagcctcaagcagcgcctggcgcgtgccgagcgggtcaaccgctggaaggcgcaagcgttgatcgcgcctctggtgctgttcctgctgctggtgtttctcgtgcctatcgccgcgctgctgtacaagagcgtcggtaacccggaagtggtcgaaggcatgccgcgcaccgtggtcgccgtggccggttgggacggacgcggcctgccggccgagccggtgtacaaggcgctgagcgaggacctggccgaagcgcgcaagcagcaaaccttgggcgatctgtccaagcgactgaacatggagttggccggctatcgcagcctgctgaccaaaaccgcccgggccctgccgttcaaggaggaaccggcttcctataaagaagcgctggaggccatcgacgagcgttggggcgacccggcctactggcaggcggtacgccgcaacaccagcagcctgacgccgttctacctgctggccgccgtcgaccatcggatcgacgacctgggggagatcgccccggcgacccctgaccaggccatctacctggatatcttcgcccggactttctggatgggcctggtgattaccggcatctgcctggtgctggcttaccccctggcgtacctgctggccaacctgccggcgcgccagagcaacctgctgatgattctggtgctgctgccgttctggacgtcgattctagtgcgcgtggcggcgtggatcgtgctgctgcaatcgggcggcctgatcaacagcgcgctgatggccatgggcgtgatcgacaagccgctggagctggtgttcaaccgcaccggggtctacatctccatggtgcacatcctgctgccgttcatgatcctgccgatctacagcgtgatgaaaggcatctcgccgacctatatgcgcgcggcgatttccctcggctgccatccgttcgccagcttctggcgggtgtatttcccgcagacctatgccggcgtcggcgccggttgcctgctggtgttcatccttgccatcggctactacatcaccccggcgctgctgggcagcccgaacgaccagatggtcagctacttcgtcgccttctacaccaacaccagcatcaactggggcatggcgaccgcgctgggcggcctgctgctgttggcgaccatcgtgctgtatctgatttacagctggctggtgggcgccagtcgcctgcgcctgagctaaggagagaatcgaatgctgagcccttacatgtcgcccgtcgagcgggtctggttctacagcttgcggattctctgcggcgtgatcctgttgttcctgatcctgccggtgctggtgatcattccgctgtcgttcaactcgggcagcttcctggtgtacccgctgcaaggcttctcgctgcagtggtatcacgatttcttcggctcggcggaatggatgcgcgccctgaagaacagcatcatcgtcgccccggcggccacggtgctggcgatggtcttcggcacgctggcggccatcggcctgacccgcggcgacttccccggcaaagcgctggtgatggcgctggtgatttcgccgatggtggtgccggtggtgatcatcggcgtggccagctacctgttcttcgcgcccctgggcatgggtaacagcttcttctcgctgatcatcgtccatgccgtgctgggcgtgccgttcgtgatcatcacggtctcggccaccttgcagggcttcaaccagaacctggtgcgggccgcggccagccttggcgcttcgccgctgacggcgttccgccgggtgaccctgccgttgatcgcgccgggggtgatcagcggcgcgctgttcgcctttgctacctcgttcgatgaagtggtggtcacgctgttcctcgccggccccgagcaagccaccttgccccggcagatgttcagcggtatccgcgaaaacctcagcccgaccatcgccgccgcggcgacactgctgatcgccttctcggtgattctgctgctgaccctggagtggctgcgtggccgcagcgaaaaactgcgtaccgcatcggtctgatcgccactgacagatcgctcccgtgccggccgtgggggcgatctgctccggcattcatcgctgaaatagcagacaaccctcaatccccagctactcttgtgccagctcccccctatataagaggccgcgcacatgagtctttcctctttcaaaatcgcccacaaactgctcaccggctccgccgcgatcgagcaactgtccaccgaactgagccgcctggatgtcgataacccgctgatcgtcactgatgccgcgctggtcaagtccggtaccgtggagctggcgctggcgcaactgggagggcgggactacgagattttcgaccgggtgctgcccgacccggaaatcgccatcgtcgaagactgcatgcaggtttaccgtgagggcgggcacgacgggctgatcggcctgggcggcggcagcgccatcgatatcgccaaaagcgtcgcggcctacgccggttatcacggggcgctggaagacctgttcgggatcgaccaggtgccgcgcaaggggccgccgctgattgccattcccaccacggcgggcactggctccgaagtcaccaatgtggcgattctctcggacaaggtcgcgcagctgaaaaagggcattgtcagcgattacctgttgccggatgtggcgctggtcagcccgcagatgaccctgacctgcccgcgcagtgtgactgccgccagcggtgtcgatgccctggtgcatgccatcgagtcgtatctgtcgctcaacgcctcgcccatcaccgactccctggcccttggcgccatcaagctgatcgcccaggcgctgcccaaggcgtacgccaatcctgcccacctgcaggcccgcgaagacatggccaccgccagcctgatggccggcatggccttcggcaacgccggggtcggcgcggtgcacgcgctggcttatccactgggcgggcgcttcaacatcgcccatggcgtcagcaatgccttgctgctgccgtacgtcatgacctggaacaagatggcctgtgtcgagcgcatgcaggatatcgctgaggccatgggggtgaagaccgctcatctgagcgcggccgaggtggccgacaaggcggtcgaggccatgacccagctctgcgccgcggtggagattccctcggggctgcgcagcttcggggtgccggaggaggcgattccgtccatggcggtggaggccgcggggatcgagcgcttgatgcgcaacaacccgcgcaaactgagcccgggcgatatagagaagatctatcgcgcggcttactgatcatcgcggtcacggtgcgcgcgccaaagcatgaggtatacaatgcgcgccaccgtgattctgctcaaaaaggtgcgtcatgcagcccttcgcaattgctccgtcgatcctctccgccgatttcgcccgcttgggcgaggaagtggacaatgttctcgccgctggcgccgatatcgtgcacttcgatgtcatggacaaccattacgtacccaacctgaccatcggtccgatggtctgcgctgccctgcgtaagtacggcatcaccgcgccgatcgacgcccacctgatggtgagcccggtggatcgcatcattggcgacttcatcgaggccggtgcgacttacatcaccttccacccggaagccacgctgcacgtcgaccgttccctgcagatgatccgcgaaggcggctgcaaggccggcctggtgttcaacccggccaccccgctggacgtgctcaagtacgtcatggacaaggtcgacatggtcctgctgatgagcgtcaacccgggtttcggcggccagaagttcattcccggcaccctcgacaagctgcgtgaggcccgtgccctgatcgatgcttccggtcgcgatatccgcctggaaatcgacggcggggtgaatgtgaacaacattcgcgaaatcgctgccgcgggcgccgataccttcgtcgcgggctcggcgatcttcaatgcgccgaactaccgggacgtgatcgagaagatgcgcgccgaactggcgctggcccgtccatgagcggtttcgagcagctgttcccggggcgtctgccgcggctggtgatgttcgacctggatggcaccctggtcgattcggttcccgacctcgcggcggccgtggacgacatgctgctcaaactggggcgtccgcccgccggtatcgaggcggtgcgcgagtgggtcggcaacggcgtgcagatgctggtgcgccgggccctggccaacgacatcgcggcgcagggcgtcgacgatgtcgaggctgagcgcgggctggagctgttcaacaatgcctatgaggatggccacgaactgactgtggtctaccccggcgtgcgcgacaccctcaaatggctgcacaagcagggcgtggaaatggcgctgatcaccaacaagccggagcgtttcgtcgcgcctttgctggatcagatgaagatcggccgttatttccgctggatcatcggtggcgataccctgccgcagaagaaacccgacccggcagcgctgttcttcgtcatgaaaatggccagtatcccggcctcgcaatcgttgttcgtcggtgactcgcgcagcgatgtgcaggcagcgaaagccgcgggcgtaaagtgcgtagcattgagctatggctacaaccacggacggccgattgccgaggaaatgccagccctggtgatcgacgatctgcgccagttaattcccggttgcctggatccggccgctgagataacgttgcccgaagctgttcaatcccctcctggaaacgccatcgtggtggtcactcgcaaactctggatgaaagtcatcaaggccctggcccgttggcgttggcgcgcctgacttgttcctggccggtcttccggcgcgtttgcatacctgactgttagaacctcaagccacgaggcaccccatgatccgcgaagaattcctgcgtttggccgctgccggctacaaccgcatcccgcttgcctgcgaaaccctggccgacttcgacacgccgctgtcgatctacctgaaactggccgaccagcccaactcctacctgctggagtcggtgcagggcggcgagaaatggggccgttattcgatcatcggcttgccctgccgcaccgtgctgcgggtgcatgaccaccatgtcagcatcaccgtcgatggcgtcgagaccgaaagccatgacgtggccgacccgctggcgttcgtcgaagagttcaaggcgcgctaccaggtgccgaccatcgctggcctgccgcgcttcaatggtggcctggtcggctacttcggttacgactgtgtgcgttatgtggagaagcgcctgggcaaatgtccgaacccggatccgatcggtgtgccggacattctgttgatggtctccgacgccgtggtggtgttcgataacctcgccggcaagatgcacgccatcgtcctcgccgacccgtcccgggacgatgccttcgagcaaggccaggcactcctgcaagcgttgctggagaagctgcgccagcccatgaccccgcgtcctggcctggacttcagcaagcagcaggcggccgacctggtgttccgctccagcttcacccagggtgactacgagcgtgccgtcgataccatcaaggagtacatcctggcgggcgactgcatgcaggtggtgccgtcgcagcgcatgtccatcgatttcaaggcggcgccgatcgacctgtatcgcgccctgcgttgcttcaatccgacgccttacatgtacttcttcaacttcggcgacttccatgtggtcggcagttcgccggaagtgctggtgcgggtcgaagacaacctgatcaccgttcgcccgatcgccggcacccgcccacgcggcgccaacgaagaggcggatctggcgctggagaaggacctgttgtccgacgacaaggaaatcgccgaacacctgatgctgatcgacctggggcgcaacgacaccgggcgggtttccgagatcggttcggtgaagctcaccgagaagatggtgatcgagcgttattccaacgtgatgcacattgtttccaacgtcactggccagttgaaggctggactgaccgcgatggacgcgctgcgggcgattctgccggcaggcaccttgtccggcgcgccgaagatccgcgcgatggaaatcatcgacgagctggagccggtcaaacggggtgtgtatggcggggcggtgggttatttcgcctggaacggcaacatggataccgccatcgccattcgtacggcggtgatcaaggacggcgagctgcatgtgcaggccggtggcggtatcgtcgccgactcggtgcctgcgctggaatgggaagaaaccctgaacaagcgtcgtgcgatgttccgcgcggtggccttggctgaacagacgcccgatagctgagtcggacagcgagccataaaaaaacgctgcctccttgcggggggcagcgttttttattgcctgctctctactagaagtcgaggctgacgccaacgttgatgccttgctgggtgaagtcatcgtccttgcggatgttgtagctggcgcgcagggccaggtcctgggtgagcttgtggctgaccccgaggttcaggcggttgaggttggtctgcggggtatagccttcgagggtgtagcggttatccggcagactgttgagggccatggtcagcttctgggtatcgtcctcgtattccttttcgtgggcgatttcgccgaatacctgggtttgccgggttatctgatacttgccttgcaggccgatgcccaggcgccgcgaggtgcgtttctggtcatcgaaggtcagggcggtggagtcgttgccgtcctcggagtaaccgtcgaccttggcccgcgcgtagtcggcgctgatgaacggcgacaggtgccacgggctgctggcctgctgcgcgatgtcgtagcccaggcgggcgctgaaggccaggacatcgccgctggtgtcgcctttttccccgcgctcattgggccccaggtcgaatttgcgcttgaggttgtcgtagtccaggtgcccggcggtggctgccgcgtcggcccaccagcggttttgctggtactggacgaaggcggtgcccaggtaggtgttgagtttgtagtccgagtcgttgttgcccgcctcgagcttctgccgataggcgccggccagcacgccgactcgccaggcctcatcgagccggtagctgccgccgatgttcaggttgaaaccgttgccgtcggcgctggcgccgctgcgctggctgtcgaagtcctggtgctggccgcccgcggcgacaatcgcccgccattgccccacgccctgccagttttcccagtcggcctgccattggttgcgcagctcatcctgatgcgcgcgcagggtgccctgggccatttccgggagcagggttatttcccagggcgccgccagcaaggagtaagcgtaatcggcgatcagccgctggccggcttcggtggggtggaccgcgtcgttgtagatcagcttgctcgggtccggcgtggcgctgtgaatgccatagcgggcgttttccgtgcagccattgccactgaagcaggtggcggtgaggttctggtcggtggccaggccgaactgtgccgggttggcgaagctttccttcaacagcacaggaatattgaggggaatgacttcggcatcgaccgtctgcagctgtcggaccagttcggtattgaattgggcactgagctgggaagtgaacccttgcaacgggctgccgttgattgccggggtcaggccgatatccggcaacagccagaccatgatgtagcgggcgccggcctgttgcagagtttgcacgctgtccaccaggcggccggccgcggcgttggcctggtcaagactggtgacgcggccctggaggaagtcgttgccaccgcccgagaggtaatagagggcgttcgggtcggcgcggaaatcgttggctaccagatagccggggcggctacggctgccggcggtcgaggtggtggtaatcgaatcgagaatctggtcggtgcgataaccgccaactgcccagttgttgccatcaggcaggccttcgctggcgcgggtcgccgaggtcgaggcggcgagctggtcatccgagaagcccagtctggctcccagcaattgcgtcgagttggcggagcggacttccccgctaccatccaggtagaccggcccggtgcggttggtaaagcgctgggtcgcgcccgcgggaccgccgggatcggcgaattgcccggcatcgctgaggctgtcgccgaacacgataaagctggaatagggggaaggggctgcgatcgcttgcgcgcaggccagggacaaaagactgccggcgagtggtacgaacaacgtctttttgatcatgagcaagtccgttttatttattgttgtagagagcgaaacgacagtaccaaaaacttttgcgtttcagctatggcgataagccatatcgcttgtttatccgggcgcgggccccgccatattgcaccctctgctcagctaagttactgtgcctgaacgtatgaatgagaccttccccgtgttgatcgtcagcaaactcttgatgcgagttgttaaggcacacgcccgttggcgttggcgcgcctaacttttctctgccggcccggccggacctgtaccgttttgccttctttatccctgttcgactccgcttgtgctggttgagtgattgcaacctccggcgggcctgccagcgggcaatccactgaaggctgtattaaaagtcagtgaattcaagaggttgtaatccccatgttgctgatgatcgataactacgactcctttacctataacgttgtgcaataccttggcgagctgggtgccgaggtcaaggtggtgcgcaacgacgaactgaccgtggctgaaatcgaagcgctcaaccctgagcggatcgtcgtgtcgcccggtccttgcacgccgaccgaagccggtgtgtccatcgaagcgatcaagcatttcgccggcaagctgccgatcctgggcgtctgcctgggccaccagtcgattggccaggcttttggcggcgacgtggtgcgcgcgcggcaggtgatgcacggtaagactagcccggtatttcaccaggacaagggcgtattcgccggtctgaaccatccgctgaccgtgacccgttaccattccctggtggtcaagcacgatacgttgccgaactgcctcgaactgaccgcctggacccaactggaagacggctccgtcgacgagatcatggggctgcgccacaagacgctgaacatcgagggtgtgcagtttcaccccgagtctattctcaccgagcagggccacgagctgttcgccaacttcctcaaacagagcggcggcacgcgctaaggactttccatggatatcaagactgccctgagccgtatcgtcggccatctcgatctgagcaccgatgaaatgcgccaggtcatgcgtgaaatcatgaccggccagtgcaccgatgcacagattggcgccttcatgatggccatgcgcatgaaaagcgaaagcatcgacgaaatcgttggcgctgtttcggtcatgcgcgagctggcggacaaggtcgagctgaaaaccctcgacggtgtggtcgatgtggtcggcaccggcggtgacggtgcgaacatcttcaacgtgtccacggcttcttcctttgtagtcgccgcagccggttgcacggtggccaagcacggcaaccgcgcggtgtccgggaaaagcggcagtgccgacctgctcgaatccgccggtatctacctgaacctgacgccggtacaggtcgcccgctgtatcgacaacgtcggtatcggtttcatgttcgcccagtcccatcacggtgccatgaagtacgccgctggcccgcgccgcgatctcggcctgcgcaccctgttcaacatgctcggcccgcttacgaatccggccggcgtgaaacatcaggtggtgggtgtgttcactcaggcgttgtgccggccgttggccgaggttttgcaacgcttgggcagcaagcacgtgctggtggtgcactctcaggatggcctggatgaattcagcctcgccgcgccgaccttcgtcgccgagctgaaggacgaccagatcactgaatattgggttcagcccgaagacctcggcataaagagccagagcttgttcggcctggtggtcgaaagcccggcggcatcgctcgagttgattcgtgatgccctggggcggcgcaagaccgagcacgggcagaaggcggcggagatgatcgtgctcaatgccggtgccgcgctctatgcggcggaccatgccagcagcctgaaagagggcgtggccctggcccatgacgctttgcacactgggctggctcgcgagaagcttgaggagttgggtgcctttaccgcggtattcaagcaggagaatgaaggatgagtgtgccgacggttctggaaaaaatcctcgcccgcaaggtcgaggaagtggctgagcgtagcgcacgagtaagcctggccgaacttgaaggccaggcccgtgtcgcggatgcgccgcgcggctttgccaaggcgctgctcgaccaggccaagctcaagcagccggcggtgatcgccgaaatcaagaaagcctcgccgagcaaaggcgtgattcgcgagcatttcgtcccggcagagatcgccaagagctatgagaagggcggcgcgacctgcctgtcggtactcaccgatatcgattatttccagggcgccgatgcctatctgcaacaggcgcgtgccgcctgttcgttgccggtgattcgcaaggacttcatgatcgatccgtaccagatcgtcgaagcccgcgcattgggggccgactgcgtgctgttgatcgtggccgcgctggatgatgccaggatggctgaactggctgccgtggccaaaggcgtgggtctcgatgtgctggtcgaagtgcatgatggcgacgaactggagcgtgccctgaaaaccctcgacacgccgctggtgggcatcaacaaccgtaacctgcacaccttcgaggtcaatctggagaccaccctcgatctgttgccgcagattccgcgcgatcgtctggtgatcaccgagagcggtatcctcaaccgggccgatgtcgagctgatggaaatcagcgacgtttactccttcttggtgggcgaggcctttatgcgggccgagagcccaggtctggaactgcaacgcctgttcttcccggaacgtggcgtgccggtgagcggttcgaccctggactgaacctgagttgatgaagaagccggcgccgccggcttttttatacctagcgcaaaggaccttgactgccatgacccagcccctttccctgaccgtcgaagccggcctgcaggccgaacaggatctgctcgcccaggtatgcagcggtgaccaggagtacggcctgttgttctggcagccgagcgacagagcgctggtgatgccgcgacgcttgagccgtttgccggggttcgatcaggcctgcgacgcgctggccgccagtggctggccggtgttgctgcgagaaaccggtggggagccggtgccgcaatcggcggcgacggtcaatatcgcgctggtttatgcgccgcctcgcagcgagggtgatcagaatcggatcgaaaccggttatcgccgtttgtgccagccgatctgcgacctgctttccgagctgggaggcgagccctccctgggtgaagtcgagggcgctttctgcgatggtcggttcaacgtcaatctcaacgggcgcaagatggtcggcaccgcccagcgttggcgccagagcaaggggggaacgcgtccggttgggttggtgcatggcgcgctgttgctggatgacgagcgggaaaccatggtggcggcggtcaatcgtttcaatcaggcctgtggcctggagcagcgttgccgcgccgagagccatatcgccttgcatgaggcattcgccgcgccgaatgccatcgagcgcctggataccctgtaccggcagatgctggcgcagttcctgccgctctaacgggtgccgaacaccaccatggtcttgcctttgacatggaccaggttgcgttcttcgaggtccttgagcacccggccgaccatctcccttgagcagccgacgatccgcccgatttcctggcgggtcaccttgatctgcattccatccggatgggtcatggcatctggctgcttgcacagttcgagcaggcagcgggccacgcgcccggtgacatcgaagaacgccaggtcgccgaccttgcgggtggtgttgcgcaggcgctgggcgatctggccgctgagcacgtacagaatgtccgggtcctgttgagacagctcacggaattttgcatagctgatctccgcgacttcacattcgaccttggcccgtacccaggcgctgcgttgctgctcatgcccggcctgttcgaacaggcccagctcgccgaaaaaatctccggcattgagataggcgatgatcatttcccgaccgtcgtcatcttcgatcaggatggtgaccgagcctttgacgatgaagaacagcgtgtccgactggtcgccggcgcagatgatgttgctcttggcctgataacggcggcgctggcaatgcatcaacagcttgtcgaggttcttgatcttgggtgtaggggcaagagcaaccatggttgtatcccgaaaagacagcacggtgtgatttggttttttatggggcggtcaagctgatcgccgatagctggcaatgcgccagtgatttggcgccagcttaacagacgcttcctttgggtaattaagaattttcctatcagaactgagtgtggcacccgaacaggcaaagcgctgtcatcccgggcccctgtgctaagctggcgacccttttttagcagtggagtcttggcgatgaaggcacgcatccaatgggctggcgaagccatgttcctcggggaatcgggcagcggtcatgtggtggtaatggatggcccgccggaagccggtggtcgtaacttgggcgtgcgcccgatggaaatgctcctgctcggcgtaggcggttgcagcaacttcgatgtggtcagcatcctgaagaaatcccgccaggctgtcgaaagttgcgaagccttcctcgacgccgagcgtgcgaccgaggaccccaaggtcttcaccaagatccacatgcacttcgtggtcaagggccgcgggttgaaagaagcccaggtcaagcgcgccatcgagctgtcggcggaaaaatactgctcggcatcgatcatgctcggtgcggccggggttgccatcactcacgattacgaaatcgtcgagctcggttgagtcgccattcaaccctcccgaattcgcggcaaaagaaagggcgctgaaaaagcgccctttttttacctgcgatttgtatcgctcagatccggtaagtgcttttggtcatgaccttggccagtaggctcatgccgaattttaccggcgccgggaagcggaatccgcccgcgtccagggcgctttcggcgtgttgttcttcgtcgatgcgcatctgctcgagaatcgcccgggatttttcgtcctcggccggcaattgctcaaggtgttcgttgaggtgtttgcacacctgatcttcggtggcagccacgaaacccaggctgaccttgtcgctgatcagcccggccactgcgccgatgccgaacgacatgccataaaacagtgggttgagcacgctggtgtggctacccagttggtgaatgcgttgctcgcaccagaccaggtgatcgatttcttcttccgcggcatgctccatggcggcgcgcacttgcggcagcttggcggtcagtgcctggccctggtacagcgcctgggcgcagacttcgccggtatgattgatgcgcatcaggccggcgacatgcttggtgtcctcttcgctcatctgcacgtccggctgcacgatggcaggggaagggcgataaggctggccgctgaagggcagcaaggtacgcattgccgcatctgcctgcagcagtagacggtcaatcggcgagtagtgacgttgggtagtcatgcttacctccgggaagaatcacggcggccagtttaccccaatcgatgggcagaggcctgcgctggatcagcacactctcggcaaaagcgggcgaggagtgtgctatcgcgcaccttggatggggatcagcccggcggccagtgcatctggcgctgacccagaacgtgcatgtgaatgtgatacacggtctggccaccgagttcattgcagttcatgacgacccggaagccttcttcgcagcccagctccctggccagacgctgggcggtgaacaggatatgtccggccagcagcttgtcgtcttcggtcaggtcattgagggtgcgtaccggctttttcggaactaccaggaaatgcacgggggcctgtggggcgatatcgtggaaggccagaacctggtcgtcctcatagatgatcttcgccggtatttcccggttgatgatcttggtgaacagagtatccacagctgtttctccgttgtgttggtccgggctgagtgtactcaggcaagccgagtgcgcccagccttagatggttgccaggtcagcgcgggcaataggctttgttgacggcgccggaaatcttgcgggtcagccagcgtgaacccaggcgcgggctgaacgcaaaccagcggttgcggcggccggggatgataatggcgcgattcttgtccagggcgcgcacggtgtacagcgcgacttcttccgggctcatcagcagtttgctgtcgttaagcttgctggtgttcagctgggcggtatcaaagaaaccggtgcgggtcgggccagggcagagcacggaaaccttcactgcattgtttttcagctcttcgcgcaggccttcggagaagtgcagtacataggccttgctggcgtagtaggtgctcatccaggggccgggatagaagccggcgatcgaagcgacgttgagaatctgcccgccgccctgcaaggccatgctgttgcccagggcatgacacagccgggtgagggccagaatgttcacttcgatcaggtcctgctcggtcatccagtcctgggcgaggaaggggccgcaggtgccgatgccggcgcagttcaccaatagatcgatctgccggtcgccttcctccagctccagcaggaaacccgaaagccgcaaaggctcggacaggtcgcaggcacggaacagcacctccacaccaaagcgttgggtcaactcgatggcgatgctttccagctgatcacgctgacgggccaccaggatcaggctgcggccgcgccgggccagcgcttcggccagggccaggcctatgccgctggaggcgccggtgatcagagcgtaacgggtcatgcggttctccattgcaacggccggttgcctgtagggaaaagtcccaggcagcggcgcgttaattcaattcgatagtctacagggggccggggcgggctcgctgctttcgctgttcctgtttctgggcgccctagaccgagctgaggccaccgatgaaggacagcagcaagacgattatccatagcgcggcaagccccttgaccgctccactgtttggcggaggcggcgcgccgtaacgattggcgccggtgttgcccggcaggatcgccagcagcagcggaaacaccgcgtacacaaatggcagcaagttcaacagccagagccagcccgaccagcccaggtcatgcaggcgctgaacggaaatggtgatgttcagataggcgaaggccagtgctacgacgccgaggaagatcattcccgtcacttgcaggctgttgccgaccagagccgcggtcaggaagccgccggccagggtagtcagcaggatcagcaccagggtccaggcgagatagcgcaggcgcccgatgcgtccatcgacggtgtagaacttcagctcgccaaactcgggaaggggatcgcctactgtggcttgaggcggggtgtagggcgaagtacccgcgccggccatggggtctggcgtcggcgtaggggccgggcgttgccagtcacttgtcacggtgggttctgcctggggcaagtccaccgaaggcgctggcgctgggggggcaggctgaggtgcaggttggctggcgcctggggcaagatccggttcgatgcgtggggcgataccggcctggttcagcgcggcgagataaatgtccgcgtcctgctgggagaggtcgcgcttgagggtgatgttttgccccttgaacagaggctcgatcgcggcgatatcgcttttgaacagcttggcgattttctgcttggcatgttcgatgtcgacgcccggaagcagagccccgtcaaatacgatcttgaaacggtcttcgctcatgcagggcttccttgtcggctatatagagagggctttcgcagggcgacagtttaaggccagccgtccgttgctggccaaaaaacatcagcgattcagcgcggccagcgttgcggtagccgggcggccagttcctgcgcggcacggtattcggcgtccaggcgggcgaccagttgatcgacgctcggcaagtcatcgatttcaccgacgccttgtccggcggaccacacggttttccaggctttggcttcatcgctgagcggcttgagtttcgagccgaagttgacttcgcctttgccctgcagggcggcaaggtcgaagccggcgttttccaggctttggcgcatgaagcttgctggaaccccggagactgccgcggtgtgcacaatgtcggcggccttggcgctcaacagcatctccttgtaggcctccggcgcatggctttccgtggtgccgataaaacgcgtgccgaagtaggcgaggtcggcgccgagcaactgtgcggcgaggatctcgtggccgtggttcaggcagccagccagcagcagcgtcttgtcgaagaactggcggatttcggcgatcagggagaacgggctccaggtcccggcgtggccaccggcgccggcggctacggcgatcagtccatcgaccccggcctcggcggctttttccgcgtggcgccgggtggtgacgtcatggaagaccaggcctccataagcatgcaccgcatcgaccagttccttcaccgcgcccaggctggtgatgacgataggcaccttgtgttcgatgcagatcgccaggtcggcattcaagcgtgggttgctgtgatgcacgatcaggttgacggcatagggcgcggggttttccagggtcgcaaggcctgcttcgatttcttccagccaggccttgaagccactgctttcacgctggttgagggcagggaaactgccgaccaccccattgcggcagcacgccagaaccagttgtgggttggaaatcaggaacattggcgcagccacgacaggcaggcgcaagcgttgttcgagcagagcgggcagcgacattggaagtaccccgaataatgacggctagtagaagttagaacggccggacgacgaccagaattacgatagccagcaataccagaactggcacttcattgaaccagcggtaaaagacatggctgcgggtgttttcgccacgggcaaaacgttttacctgggcgccgcacatatggtggtagccaatcaggatgaccaccagggtcagcttggcatgcatccagccgccctggccgaagtaggcgctggggttcaggctcagcagccagataccgaaaatcagcgtggcaatcatcgctgggcccatgattccgcggtacagcttgcgctccatgatgctgaagcgttccttgctgatcgtgtcttcgctttgagcgtgataaacgaacaggcgcggcaggtagaacagaccggcaaaccagcagaccagactgacgatgtgaaaggctttgagccacagatagagcatttcggttattcccaggttcacggtagcgaagatagtagtggcaggagcgtccgcacgtcaccttgacggttgtcgcaggggcgcgcggcccctattatcgacggctttccagtgggttcgttgagggcaggtttatggtcaaggtcggtatcgtcggcggcacgggttacaccggggtcgaactgctgcgtctgttggcacagcatccgcaagcagaagtggtggtcatcacttcccgatccgaggcaggccttgccgttgccgatatgtacccgaacctgcgaggccactatgacggcctggcattcagcgttccggacatcaagacccttggtgcctgcgatgtggtgttcttcgcgactccgcacggcgttgcccatgccctggcgggtgagctgctggctgccggtaccaaggtcatcgacctgtcggcggatttccgtctgcaggacgccgatgagtgggccaagtggtacggccaaccccatggggcccctgagttgctcgacgaagccgtctatggcctgccggaagtcaatcgcgagcagatcaagacggcacgcctgatcgctgttccgggttgctacccgaccgctacccaactcggcttcctgccattgctggaagctgggctggctgacacttcgcggctgatcgccgactgcaagtcgggtgtcagcggggcgggtcggggtgccagcgtcggctccctgtactccgagacttcggaaagcatgaaggcctatgcggtcaaaggtcatcgtcacctgccggagattcgccagggcctgcgccgtgcggcgggcaaggatgtcggcctgacgttcgtgccgcacctgacgccgatgatccgtggcattcactcgacgctctattccactgtcgtagacaagtcggtggacctgcaggcgctgttcgagaaacgttatgccaacgagccgttcgtggatgtgatgccggcgggcagccatccggaaacccgcagcgtgcggggcgccaacgtatgccggattgccgtgcaccgtccgcaggatggcgatctggtggtcgtgttgtcggtgatcgacaacctggtcaaaggcgcgtcgggccaggccgtacagaacctgaacatcctgttcggtctggacgagcgtctgggcctgtcccacgccggcatgctgccttaaggcgtctgcctgcttcagcaaaaggcccgttatgggcctttttgcattttgcggtgagccctgggcttattgatataccgtaacaatagttgaccgcttttctgggagaagcggataatgcgcgtcatcacgcattatggcggcgtaacgccgggagatagtcagcatgagcgtcgaatccttcacccccacggctttgcaatttacccacggtgccgcgcacaaggtgaagagcctggtcgatgaagagggtaatgatcgcttgaagctgcgcgtattcgttacgggcggcggttgttcagggtttcagtacggcttcactttcgatgaagaagtcgcggatgacgacaccatcgtcgagcgcgaaggcgtcagcctggtggtcgatccgatgagcttccagtacctggcgggtgccgaggtggattatcaggaaggtctggaaggttcgcgtttcgtgatcaagaatccgaatgctacgaccacttgcggttgcgggtcttcgttctcgatctgatcgctgaataaggttttaccaagcgccgcagggctttcggggtctgcggcgttttgctgtctggcgatcaggcggggtagatcgcgcccaggatgcgcaagccgcgggcgccggtgacacttgggcggttggcggctatgccttccaggcagcagtgggccagccaggcgaatgccatggcttcaacccagtccggatcgactccatgggtggcggtactgctgaccgcggtgttaggcagcaggcttgacaggcgattcatcaaggccgagttgtgagcgccgccaccgcagaccagcagctcctgggtatcggtctgcgcggcttgcagcgactcgacgatggtcagcgcggtcagctccagaagcgttgcctgtacgttttcggggggcaaggctggcaggcgagccagatgttcctgtagccactccaggttgaatacctcgcgacccgtactcttcgggccttgagtggcaaagaatgggtcgctgagcagcgcgttcagcagcagcggctcaacctgaccgctggcagcccattggccatcgcgatcgtagttttctccacgctgggcattgatccaggcatccagcaggacgttacccgggccgcagtcgaagccggcaaccggcttgtcgctctcgatcaggctcaggttgctgaagccgccgacattgaggaccgcgcgcttgccgcagctttgatcaaagagcgcttcatgaaaggccggtaccagtggagcgccctggccgccggcggcgacgtcgcggctgcggaagtcgctgacaaccgtgattccggtcagctctgtcagtaatgccgggttgccgatctggaccgtgaagccgcgggtgggctcgtggcggatggtctggccatgactgccaatggcgcggatgtctgcgggtttaagtttctgttgggcaagcaggctatgaataccctgggcggccagttttacccagttttgctgggcgatggcggagcgggtgatttcatcgggaccgctggcgcacaagccaagcagctcagcgcgcagggattcaggcatgggaatgtaatgcgtggcgatcagcctgatcgccggtgtttgctcgatgagtgcgatatccaggccatcaagactggtcccggacatcacacctatatagagcgccatgcttaacgcttgttcgaagcgagcagggtggctttttcctgatccatccgcgccatcagcggctggctttgttgcaggaagcgcgcgcgttccgctttggcgatcggatcggccattggcagcttctggcccagtggatcgacgtgaacgccgttgacctggaactcgtaatgcaaatggggccccgtggaaagtccggtggtgccgatgtaaccgatcacctggccctgcttgacggttccgccagtcttgacgcctttggcgaagccttgcatatggccgtacagcgtgcggtaagcattgccgtgttggatgatcacggtgttgccatatccgccacgacgcccggccaggagcaccttgccatcgccggctgccttgattggcgtaccgcgaggggctgcgtagtcgacgcctttgtgagcgcggatcttgttcaggatcgggtgtttgcggcccatggagaagcgcgaactgatacgtgcgaagtccaccggcgtacggataaaggccttgcgcatgctattgccatcagcggtgtaataactgctcatgccttgtttgttggtgtagcgcaccgcggtgtaggtcttgccacggttggtgaagcgggcggagagaatgttgcgggtacccacggctttaccattgacgacggtctgttcgtagatcacgtcgaactcgtcgccggggcgaatatcctgggcgaagtcgatgtcgtagccaaagacgttggccatgtccatcgtcagactgtgagagaggccggcacgtgctgcggattgcgacagcgagctgttgatcacgccatgaacgtaggccgtgcgcaccatgggcttggcggtgatacggctgaaggcgaagccttttggccctttggtcagggtgatgctttccaggtcattgaccttgctgtgcagattgttcaactggccgtccggacccagttcgaactcaagtttctggccgcgcttcaactgggtgaactgcttggcttgcttgtcgctggccaacacgtcatgcaccgaagtggcaggtaggccgaccttctcgaatagcgtggaaagggtgtcgcccttggcaacaatgacttccctgtgattcgctgccttcttttcttccgccacggccggagttggctgttcttgagcggtttcagtggttttcgcagtgtcttcggggctgttttcgatttgtgcgaacggggacgctacggcttcatttgtggcttgtacggcgtctgcggcgtcttgatcttgtgtcagttgttcggccgggctttccaggtcgaggctcagagttgttcttttggcttctacatcgctggaagggaataccaggagcgccaggctgaggagggcggcgataccacttgcggcgagcaggtgggtcttcggataaagcggcggggctttaggcggttctgtgatcataagtaattttgactttggaaaagatgaattggaaaagatgaatgacatgatgaagatgaaataactgtataaaatataaccaaatcatctgttaagcaagcctgcggacgtcctgttcgcggaaagccatccgtacgccgggcaaaacttgtaattgggcgctgatcttgtatggttggttccctttgaatctgagccttgcgggtctgttatgaagtcggttgaagagcagctagcgctgatcaaacgtggtgcagaagagttgttggtcgagtccgagctgatcgaaaagctcaagcgcggtcagccgctgcgtattaaggctggcttcgacccaacggcgccggatttgcacctgggtcataccgtgcttattaataagctgcgccagttccaggatctgggtcatcaggtgatcttcctgatcggcgacttcactgggatgatcggtgatccgagtggcaagagcgcaactcgtccgccactgactcgcgagcaagtcctcgaaaatgccgagacctacaagagtcaggtgttcaagattctcgacccggcgaaaaccgaggtggccttcaactccacctggatggacaagatggggcctgcggacttcatacgcctgacgtcccagtacaccgttgctcgcatgctcgagcgtgacgacttcgacaagcgctattccaccaatcaacccattgccatccatgagttcctctatccgctggttcagggttatgactcggtggcgctgcgtgccgatgtggagttgggcggtaccgatcagaagttcaatctgttgatggggcgtgagctgcagcgcggttatggtcaggaggctcagtgcattctgacgatgccgttgctcgaggggttggacggcgtcaagaagatgtccaagtcgctgggtaactatgtaggtatccaggaagcaccgggtgtcatgtatagcaagctggtctccattccggatgcgttgatgtggcgttacttcgagctgctgagcttccgctccatggatgagattctttcctttaaggctgatgtcgaggcgggtgcgaatccgcgggatatcaagatcaagctggctgaagaaatcgttgcgcgtttccatggtgaggaggctgcagcgaatgctcatcgtgctgcgggcaaccgcatgaaggatggtgagctgccggatgatctgcctgagatcgagctggctgctgctgaagacatgccgatcgcggctgtccttaataaggcaggcttggtaaagaactcggcaatggcgcgtgacctgctcggttcgggtggtgtgcgtatagatggtgaggttgttgagcgttcctttatatgggctgtcggttcgactcatgtttgccaggccggaaagaaggcttttgcacgtattacgcttaaatccgaataaaactgaaaataggtgttgacggcgaattatatctctctataattcgccccacttccggcgcagtcgaaacggaaaattccttgagattcaacgagttacacggttttcgacagcggccacgcttcagttcatcgaagcccgaaggagttgattcggcagtgtgttttcgccgaatgaacgattcgatcttctcggtcgaaagcggagaaaaagaggtgttgacagcagcgtgtaacgctgtagaattcgcctcccgctgacgagagatcggaagcgcaagtggttgaagttgcaaaggaaactttgaaagcttcttaaaataaccgcttgacagatacagaggctgctgtagaatgcgcgcctcggttgagacgaaaggcttaaccaaccgctctttaacaactgaatcaagcaattcgtgtgggtgcttgtggagtcagactgatagtcagaaagattatcagcatcacaagttactccgcgagaaatcaaagatgtaaccaacgattgctgagccaagtttagggttttctcaaaacccaaagatgtttgaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttgcctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgacatcagctgcttcataagctcccacacgaattgcttgattcattgaagaagacgattgggtctgtagctcagttggttagagcgcacccctgataagggtgaggtcggcagttcgaatctgcccagacccaccaattactggtgcaccctgtagcgatacggggccatagctcagctgggagagcgcctgccttgcacgcaggaggtcagcggttcgatcccgcttggctccaccattacagattggtgtccatcgtttaaagcttagaaatgagcattccatcaagttgatggtgaatgttgatttctgatctttatcagaatcgttctttaaaaatttgggtatgtgatagaaagatagactggatagcactttcactggtgtttattcaggctaaggtaaaatttgtgagtttaatcgcgaattttcggcgaatgtcgtcttcacagtataaccagattgcttggggttatatggtcaagtgaagaagcgcatacggtggatgccttggcagtcagaggcgatgaaagacgtggtagcctgcgaaaaagcttcggggagtcggcaaacagactttgatccggagatgtctgaatgggggaacccagccatcataagatggttatcttgtactgaatacataggtgcaagaggcgaaccaggggaactgaaacatctaagtaccctgaggaaaagaaatcaaccgagattcccttagtagtggcgagcgaacggggactagcccttaagtggctttgagattagcggaacgctctggaaagtgcggccatagtgggtgatagccctgtacgcgaaaatctcttagtcatgaaatcgagtaggacggagcacgagaaactttgtctgaatatggggggaccatcctccaaggctaaatactactgactgaccgatagtgaactagtaccgtgagggaaaggcgaaaagaaccccggagaggggagtgaaatagatcctgaaaccgtatgcgtacaagcagtgggagcagactttgttctgtgactgcgtaccttttgtataatgggtcagcgacttatattcagtggcgagcttaaccgaataggggaggcgtagcgaaagcgagtcttaatagggcgtttagtcgctgggtatagacccgaaaccgggcgatctatccatgggcaggttgaaggttaggtaacactgactggaggaccgaaccgactaccgttgaaaagttagcggatgacctgtggatcggagtgaaaggctaatcaagctcggagatagctggttctcctcgaaagctatttaggtagcgcctcatgtatcactgtagggggtagagcactgtttcggctagggggtcatcccgacttaccaaaccgatgcaaactccgaatacctacaagtgccgagcatgggagacacacggcgggtgctaacgtccgtcgtgaaaagggaaacaacccagaccgtcagctaaggtcccaaagttatggttaagtgggaaacgatgtgggaaggcttagacagctaggaggttggcttagaagcagccaccctttaaagaaagcgtaatagctcactagtcgagtcggcctgcgcggaagatgtaacggggctcaaaccatacaccgaagctacgggtatcacgtaagtgatgcggtagaggagcgttctgtaagcctgtgaaggtgagttgagaagcttgctggaggtatcagaagtgcgaatgctgacatgagtaacgacaatgggtgtgaaaaacacccacgccgaaagaccaaggtttcctgcgcaacgttaatcgacgcagggttagtcggtccctaaggcgaggctgaaaagcgtagtcgatggaaaacaggttaatattcctgtacttctagttattgcgatggagggacggagaaggctaggccagcttggcgttggttgtccaagtttaaggtggtaggctggaatcttaggtaaatccggggttctaaggccgagagctgatgacgagttaccttttaggtgacgaagtggttgatgccatgcttccaagaaaagcttctaagcttcagataactaggaaccgtaccccaaaccgacacaggtggttgggtagagaataccaaggcgcttgagagaactcgggtgaaggaactaggcaaaatggcaccgtaacttcgggagaaggtgcgccggtgagggtgaaggacttgctccgtaagcccatgccggtcgaagataccaggccgctgcgactgtttattaaaaacacagcactctgcaaacacgaaagtggacgtatagggtgtgacgcctgcccggtgccggaaggttaattgatggggttagctaacgcgaagctcttgatcgaagccccggtaaacggcggccgtaaactataacggtcctaaggtagcgaaattccttgtcgggtaagttccgacctgcacgaatggcgtaacgatggcggcgctgtctccacccgagactcagtgaaattgaaatcgctgtgaagatgcagtgtatccgcggctagacggaaagaccccgtgaacctttactatagctttgcactggactttgaatttgcttgtgtaggataggtgggaggctttgaagcgtggacgccagttcgcgtggagccatccttgaaataccaccctggcaactttgaggttctaactcaggtccgttatccggatcgaggacagtgtatggtgggtagtttgactggggcggtctcctcctaaagagtaacggaggagtacgaaggtgcgctcagaccggtcggaaatcggtcgtagagtataaaggcaaaagcgcgcttgactgcgagacagacacgtcgagcaggtacgaaagtaggtcttagtgatccggtggttctgtatggaagggccatcgctcaacggataaaaggtactccggggataacaggctgataccgcccaagagttcatatcgacggcggtgtttggcacctcgatgtcggctcatcacatcctggggctgaagccggtcccaagggtatggctgttcgccatttaaagtggtacgcgagctgggtttagaacgtcgtgagacagttcggtccctatctgccgtggacgtttgagatttgagaggggctgctcctagtacgagaggaccggagtggacgaacctctggtgttccggttgtcacgccagtggcattgccgggtagctatgttcggaaaagataaccgctgaaagcatctaagcgggaaacttgcctcaagatgagatctcactggaaccttgagttccctaaagggccgtcgaagactacgacgttgataggttgggtgtgtaagcgctgtgaggcgttgagctaaccaatactaattgcccgtgaggcttgaccatataacacccaagcaatttgcgcttaacagccagattgcggtgtgtgaagacgaaacgaaccgaaagttcgagaaaacacacaaactatcgcatacccaatttgctgaaacgtcgaaagacgcgtcggcacaccgaatttcttgacgaccatagagcattggaaccacctgatcccatcccgaactcagcagtgaaacgatgcatcgccgatggtagtgtggggtttccccatgtgagagtaggtcatcgtcaagattaaattccgaaaccccaattgcgaaagcaattggggttttgtttttgcgcgcggaaaaacctttccagtcaacggagagcagcgtccttcgacttcaaattgcagctgctagctgcttgattgtgcctggtcacgctttctatgcaacagccttaggcatggctatcatgcctgcctcattgtgaggcgagatctgcatgctgacattgttggagcttctgaaggatgggcggtttcactcgggccaggcccttggtgccgccttgggtgttagtcgcagtgccgtgtggaagcagttgcagcagttggaggctgagctggggctctctatccataaagttcgcggccgcggttatcagctggcggctccgctgacgcttctggatccggctgatatttacgagcaatcaaaggattgcccttgggctgtgctggttttcgattctatcgactctacaaacgccgaagctctgagggctgtcgagcgtggtgtgcctacgccgttcctggtgctcgctgagcgtcagacggcggggcgtggtcggagagggcgaaaatgggctagcccttttgcagaaaatgtctattacagcctcgtactgcgtatcgatggtggaatgcgtcagcttgaagggctcagcttggtagtcgggttggcggtcatgcagaccttgcgcgagtttggaattgctggtgcgggcctgaagtggccaaacgatgttttagttggacgcaaaaaaatcgccggaatcctgttggagttgtttggggatcctgctgatgtctgtcatgtagttctgggtgtaggtatcaacgtcagcatgcagaaaaccgacgagattgatcagcagtggacgtctgtacggcttgagtccggcaagcaggttgatcgcaaccagttggttgctcggctgaacatgatgctgaaggcttacctggagcgccaccaaacccagggcttttcctctattcaagaggagtgggagcagaatcacttgtggcaaggtagtgcggtgtctctgattgctggggtcaataaaatagacggtgttgttatgggcatcgatcagcagggcgcattgcgattgagggtggatggggttgagaaggtctacagcggtggtgagctcagcttgaggttacgtgatgattcttgagcttgattgcggaaacagcttcattaaatggcgcgttctggataatgctgcgcttggggtatttgctgagggtgtggttgattccgatgatgctttggtcgggcatctgcgtacgctaaacggcttggttttgacccgctgccgcttggtcagcgtgcgcacggctgaggagacgagcaagcttacttccatgttggtacaggcttttggcgtggcggtgatctgtgctgtgcctgcgaaagaaatggccggcgtacgaaatggttatgaggagtttgagcgacttggcctggatcgctggcttgccatgctgggaggctttcgccttgcggctggtgcctgtctggtactcgatttcgggacggcggttactgcggatttcattgctgcggatggcgagcacctgggggggtttatctgcccagggatgtcattgatgcgtaatcagctgagaactcacactcgtcgaattcggtacgatgatttgtctgccgaacgcgcgctggtgagcctgttgccgggtcgaacgacggttgaggcggtagagcgcggctgctcattgatgttgagggggttcgttctaactcagttggagttggcgcgtggttactggggggatgatttcgtagtatttctcaccggtggtgatgctgatctggtttctggggttgtgccgcaagggcgagtggttccggatctggtttttgtcggattggctatggcatgcccattgtcctgaggtttctatgcgctggttgttcctgctgctcctggttctcaatgtgttctattacgtctggcatcagcaggaagcgcctttacgtgccaaagaggtaacacctctgacgctttataaagggtcccagcaggatatccgcttgttgagtgagtcgtctggcgcgctctctaggcgtgacaacggggggggggctcaagccgattgcctctatataggtggttttgctcgtcgtgatcaggctcaaatgcttgagcagcgtctgtcggcattgggggtggaggtccgattgaagtccctggggttgcctgatgcttctggttactggttgcgggtggctcctgaaagcaagcatttgctggatgattcgctgctgcagaatcttgctaaagaattcaatgagttaaaacataaaataatgtcatgcgaaggcattgcaactgccgaatagtttgcatagaatggcgcccgctccgcagtgaagacctctagaggtagacgcagcgaagcaaggtcaacgcagctaacctcaggtttttaatgagaaaatgcttgacagaagggtggcatgatgtagaatgctgcctcgcttaggaggggttcccgagcggccaaagggatcagactgtaaatctgacgtctacgacttcgaaggttcgaatccttccccctccaccagatttggcgtgagctgcaggctccgcgggtatagtttagtggtagaacctcagccttccaagctgatgatgcgggttcgattcccgctacccgctccaagtttgcaggttgtgcaaagtgtttcgctcttgtagctcagttggtagagcacacccttggtaagggtgaggtcagcggttcaaatccgctcaagagctccatataacaaggcagatatgaagatatctgcctttgttttaatggcttgtgtgacttgctcaattcttctcctaggggtgatttcgatggctaaggaaaagttcgaacgtaataagccgcacgtcaacgttggtaccattggtcacgttgaccacggtaaaaccactctgactgctgctctgactcgcgtctgctccgaggttttcggttcggctcgtgttgacttcgacaagatcgacagcgccccggaagaaaaagctcgtggtatcaccatcaacaccgcgcacgtagagtacgactcgaacattcgtcactacgcgcacgttgactgcccgggtcacgccgactacgtcaaaaacatgatcactggtgctgcccagatggacggcgcgatcctggtttgctcggctgccgatggtccgatgccacaaactcgcgagcatatcctgctgtcccgtcaggtaggcgttccgtacatcgttgtcttcctgaacaaggctgacatggtagacgacgctgagctgctggagctggttgagatggaagtgcgcgacctgctgagtacttacgacttcccaggtgatgacactccaatcatcatcggttcggctctgatggctctgaacggccaagacgacaacgaaatgggcactaccgctgttaagaggctggtagaaactctggatacctacatcccagagccagagcgtgctatcgacaagccgttcctgatgccaatcgaagacgtattctcgatctccggccgcggtaccgtggtaactggtcgcgttgagcgtggtatcgttcgcatccaggaggaagttgagatcgttggtctgcgcgacactcagaaaaccacctgcaccggtgttgagatgttccgcaagctgctggacgaaggtcgtgctggtgagaactgcggcgttctgctgcgtggcaccaagcgtgacgacgttgagcgtggtcaggttctggttaagccaggtaccgttaagccgcacaccaagttcactgctgaagtgtacgttctgagcaaagaagaaggcggccgtcatactccgttcttcaaaggctaccgtccacagttctacttccgtactactgacgtgactggtaactgcgagctgccagaaggcgttgaaatggtaatgccaggtgacaacatccagatgactgtcactctgatcaaaaccatcgcgatggaagatggtctgcgtttcgctatccgtgaaggcggtcgtaccgtcggcgctggtgtcgtagccaaagtcatcgagtaagttcttgatatatctccatcgggccggcataatggtcggcctgattttgtttttaggtcagtagctcaattggcagagcgacggtctccaaaaccgtaggttgggggttcgattccctcctgacctgccagattcacttggtgtgtctggctttcttttcacaggatcttcatagatgactcctaaagctgaagctcaaggctctcgcttcgatctgctcaagtggcttgtagtagttgctttggtggtcgttggcgttgtcggtaatcagtattactctgcttcgccgatcctgtaccgtgtgctcgctttgcttgctatcgctgctgtagctgcctttgtaggcctgcagactgccaggggcaagtctttctttgtactggttaaggaagctcgcaccgagattcgtaaagtcgtatggccaactcgccaagaaaccacgcagaccacgttgatcgtagtggctgttgttctggttatggcgttgctgttgtgggggcttgactccctgctcggctggctcgtttccttgattgttggctaagggtgtcccgtggctaagcgttggtacgttgtgcatgcttactcgggttacgagaagcatgtaatgcgttcgttgatcgagcgcgtaaagctggctggcatggaagatggctttggtgaaattctggttcccactgaagaagtggttgagatgcgtaatggccagaaacgcaaaagcgagcgcaaattcttccctggttatgtgttggttcagatggatatgagtgagggtacttggcacttggtcaaggatactcctcgggtgatgggttttatcggtggtactgccgacaagcctgcgccaattacggacaaagaggcagaagccattctgcgtcgtgttgctgatggtagtgacaagcccaagcctaagactttgttcgagccgggtgaggttgtccgtgttaccgatggtccgttcgctgattttaacggcactgtcgaagaagttaactacgaaaagagccggatccaagtggctgtgctcattttcggtcgctctactccggtagagctagagttcagtcaggtcgaaaaggcataactgaacgagaatcccataccccgcagcccaaggctgtggggttttttcgtcactgggataaacgcgcaagtaaccggggagcctttccaggcgtttgaacccgtaattggagtgcctcatggctaagaagattactgcttacatcaagctgcaagtgaaggccgcacaggccaacccaagtccacccgtcggtccagctctgggtcagcacggcgtgaacatcatggaattctgcaaggccttcaacgcccgtacccagggtcttgaaccaggtctgccgactcctgtgatcatcactgtttacagtgaccgcagcttcactttcgaaactaagagcacccctgcttcggttctgctgaagaaagctgctggcctgaccagcggttccgctcgtccgaacaccgttaaggttggcactgttacccgtgctcagctggaagaaatcgcgaaaaccaaaaacgcggatctgactgcagctgatatggatgcagccgtgcgtactatcgccggttctgctcgtagcatgggccttaacgtggagggtgtgtaatggctaagctgaccaagcgccaaaaggctatcgccggcaagattgaagcgggcaaggcctacagcttcgtagacgcagctgctctcctgaccgagctgtcgaccgtcaagttcagcgagtctgttgacgtcgctgtaaacttgggtgttgacccacgtaaatccgaccaggttgttcgcagcgctaccgtgctgccacacggcactggcaagactgtacgtgtagctgtgttcacccaaggcccagccgctgaagctgccctggctgccggtgctgatcgcgtaggtatggacgacctggctgccgaaatgaaaggcggcgacctgaactatgacgtagttattgcttccccggatgcaatgcgcgttgtaggtcagctgggccagatcctcggcccacgcggtctgatgcctaaccctaaggttggtaccgtaactccagacgtagctggcgctgttaaaaacgccaaggccggtcaggttcgttatcgcaccgacaaaaacggcattatccacacttccgttggcaaggtcggcttcgacgccgtcaagctgaaggaaaacgttgaagccctgatcgctgatctgaagcgtatcaagccagcttcctcgaaaggtatctacgtcaagcgcgttaccctgagcaccactatgggcccaggtctggtcatcgaccaaggttcgctggacgtataagacacagattgacgcaagagattgcgtcaattgaaagattggggtccctgcctggcgggggctatccaagaccgtaggcgacgcaagtcttaaaccacaagcctacgcagatggtgctcccggttccttaccgaatcagacaccaaaacgacatccggcctcggttggatgaaacggtaacaagcaggagttaaacccgtggcaattaaactcgaagacaagaaggccatcgtcgctgaagtcaacgaggctgccaaaggcgctctgtccgctgtcgtggctgatgcccgtggtgtgacagtaggcgctatgaccggactccgtaaagaggcccgcgaagctggcgtgtatgtacgtgtcgtacgtaacaccctgctcaagcgcgctgttgaaggcactcaatatgacgtgctcaacgacgcgttcgtcggcccgaccctgattgcattctccaaggaacatccgggcgctgctgctcgtattttcaaagagttcgcaaagggtcaggaaaagttcgagatcaaggcagctgcgttcgagggcaagtacctcgcagcaaacgagatcgacgtgttggcttcgctgccaactcgcgacgaagctattgcgaagctgatgagcgtgatccaaggcgctaccagcaagctggctcgtactctggcggccattcgcgaccagaaagaagctgctgctgcctaaggcactggaagccctttcaaaatcatatgtttaatttgatggctgcgtaggctgtcaccccaatacaggaatttatagtcatgtctctgactaacgagcaaatcatcgaagcaatcggccagaaaaccgttctggaggttgttgagctgatcaaagcaatggaagaaaccttcggcgttaccgctgctgttgccgctgctggtccagctgctgctgccgctgttgttgaagagcaaactgaattcaacgtcatgctgactgaagctggcgagaagaaagttaacgtgatcaaggctgtacgtgaactgaccggtctgggcctgaaagaagccaaggctgtagttgacggcgctcctgccatggttctggaaggcgttgctaaagaagccgctgacaaagccaaagcagctctggaagaagcaggcgctaaagtcgagctgaagtaagcatcgactttgtgtctccagcccaagcgttaagctgaggctgatggctggtggctcttgccaccggcctttttccgttattggcagccgactgggtcggtgcttttaacgtgctgtaaccaccctgtgcggtggcgcaaaccaaagggtttgcacgattttctggctgctcccgtcgggaggggccaaataagcaggtgaccaagctggggaacgctgatggcttactcatatactgagaaaaaacgtatccgcaaggactttagcaagttgccggacgtcatggatgtgccgtacctcctggccatccagctggattcgtatcgtgaattcttgcaagcgggagcgactaaagatcagttccgcgacgtgggcctgcatgcggccttcaaatccgttttcccgatcatcagctactccggcaatgctgcgttggagtatgtcggttatcgcctgggcgaaccggcatttgatgtcaaagaatgcgtgctgcgcggtgtaacttacgccgtacctttgcgggtaaaagttcgtctgatcattttcgacaaagaatcgtcgaacaaagcgatcaaggacatcaaagagcaagaagtctacatgggtgaaatccccctgatgactgagaacggtaccttcgtaatcaacggtaccgagcgtgtaatcgtttcccagctgcaccgttcccctggcgtattcttcgaccacgaccgtggcaagacgcacagctccggtaagctgctgtactccgcacgtatcattccttaccgcggttcctggttggacttcgagttcgacccgaaagactgcgtgttcgtgcgtatcgaccgtcgtcgcaagctgcctgcatcggtactgctgcgcgcgctgggctacaccactgaagaagtgctggatgctttctacaccaccaacgtattccatgtgcgcggcgaaagcctgagcctggagctggtgcctcagcgcctgcgcggtgaaattgcagtcctcgatattcaggatgacaaaggcaaggttattgtcgagcagggtcgtcgtattaccgctcgtcatatcaaccagctggaaaaagccgggatcaaagagctggaagtgcctctggactacgtcctgggtcgtactaccgccaaggtcatcgtgcatccggccaccggcgaaatcctggcagagtgcaacaccgagctgaacaccgagatcctggcgaagatcgccaaggctcaggtcgtgcgtatcgaaacgttgtacaccaacgatatcgactgcggtccgttcgtttccgacactctgaagatcgactccaccaccaaccagctggaagcgttggtcgagatctatcgcatgatgcgtcctggcgagcctccaaccaaggatgcggccgagaccctgttcaacaacctgttcttcagccctgagcgctatgacctatctgcggtcggccggatgaagttcaaccgtcgtatcggtcgtaccgagatcgaaggttcgggtgtgttgtgcaaggaagacatcgttgctgttctgaagactctggtcgacatccgtaacggcaaaggcatcgtcgatgacatcgaccacctgggtaaccgtcgtgttcgctgcgtaggcgaaatggccgagaaccagttccgcgttggcttggtacgtgttgagcgtgcggtcaaagagcgtctgtcgatggctgaaagcgaaggcctgatgccgcaagacctgatcaatgccaagcctgtggctgcggcggtgaaagagttcttcggttccagccagctgtcccagttcatggaccagaacaacccgctgtccgagatcacccacaagcgtcgtgtctccgcactcggcccgggcggtctgacccgtgagcgcgcaggcttcgaagttcgtgacgtacacccgactcactatggtcgtgtatgcccgattgaaacgccggaaggtccgaacatcggtctgatcaactccttggctgcctatgctcgcaccaaccagtacggcttcctcgagagcccgtaccgcgtggtgaaagaaggtctggtgaccgacgagatcgtgttcctgtccgctatcgaagaggccgatcacgtgatcgcccaggcttcggcgaccatgaacgacaaaggtcagctgatcgatgagctggtagctgttcgtcacttgaacgaattcaccgttaaggcgccagaagacgtcaccttgatggacgtttcgccgaagcaggtagtttcggttgcagcgtcgctgattccgttcctcgagcacgacgacgccaaccgtgcgttgatgggttcgaacatgcagcgtcaggctgtaccaaccctgcgtgccgacaagccgctggtaggtaccggcatggagcgtaacgttgcccgtgactccggcgtttgcgtcgtggctcgtcgtggcggcgtgatcgactcggttgacgccagccgtatcgtggttcgtgttgcggatgacgaagttgaaccaggcgaagccggtgtcgacatctacaacctgaccaaatacacccgctccaaccagaacacctgcatcaaccagcgtccgctggtgagcaagggcgatcgggttcagcgtagcgacatcatggccgacggtccgtccaccgacatgggtgagctggctctgggtcagaacatgcgcatcgcgttcatggcatggaacggcttcaacttcgaagactccatctgcctgtccgagcgtgtggttcaggaagaccgcttcaccacgatccacatccaggaactgacctgtgtggcccgtgacaccaagcttggcccagaggaaatcactgcagacatcccgaacgtgggcgaggctgcactgaacaagctggacgaagccggtatcgtttatgtgggtgctgaagttggcgcaggcgacatcctggtcggtaaggtcactccgaaaggcgagacccagctgactccggaagagaaactgctgcgtgcaatcttcggtgaaaaagccagcgacgttaaagacacttccctgcgtgtacctaccggtaccaagggtactgtcatcgacgtacaggtcttcactcgcgacggcgtggagcgtgacgctcgtgccttgtcgatcgagaagagccagctcgacgagatccgtaaggatctgaacgaagagttccgtatcgttgaaggcgccactttcgaacgtctgcgttccgctctggtcggccacaaagccgaaggcggcgccggtctgaagaaaggtcaggaaatcaccgacgaagtactcgacggtcttgagcatggtcagtggttcaagctgcgcatggctgaagatgctctgaacgagcagctcgagaaggctcaggcctacatcgttgatcgccgccgtctgctggacgacaagttcgaagacaagaagcgcaaactgcagcagggcgatgacctggctccaggcgtgctgaaaatcgtcaaggtttacctggcaatccgccgccgcatccagccgggcgacaagatggccggtcgtcacggtaacaagggtgtggtctccgtgatcatgccggttgaagacatgccgcacgatgccaatggcaccccggtcgacgtcgtcctcaacccgttgggcgtaccttcgcgtatgaacgttggtcagattctcgaaacccacctgggcctcgcggccaaaggtttgggcgagaagatcaaccgcatggtcgaagagcagcgcaaggtcgcggaactgcgtaagttcctggacgagatctacaaccagatcggcggtcgtaacgaagatctggatagcttctccgatcaggaaatcctggatctggcgaagaacctgcgcggcggcgtgccgatggccactccggtgttcgacggtgccaaggaaagcgaaatcaaggccatgctgaaactggcggacctgccagaaagcggccagatgcagctgaccgacggccgtaccggcaacaagttcgagcgcccggttactgttggctacatgtacatgctgaagctgaaccacttggtagacgacaagatgcacgctcgttctaccggttcgtacagcctggttacccagcagccgctgggtggtaaggcgcagttcggtggtcagcgtttcggggagatggaggtctgggcactggaagcatacggtgccgcatacactctgcaagaaatgctcacagtgaagtcggacgatgtgaacggccggaccaagatgtacaaaaacatcgtggacggcgatcaccgtatggagccgggcatgcccgagtccttcaacgtgttgatcaaagaaattcgttccctcggcatcgatatcgatctggaaaccgaataacacgtgacgcgaatcgagagcggggcaggattgcccgctctctgctccgccaggaggaaaggccttgaaagacctactgaatttgctgaaaaaccagggtcaagtcgaagagttcgacgccatccgtatcggattggcctcgcctgagatgatccgttcgtggtcgttcggtgaagttaaaaagccggaaaccatcaactaccgtacgttcaagcctgagcgtgacggcctgttctgcgccaagatctttggcccggtaaaggattacgagtgcctgtgcggtaagtacaagcgcttgaagcatcgtggcgtgatctgcgagaagtgcggcgttgaagttgcactggccaaggttcgtcgtgagcgtatggcgcacatcgaactggcttcgccggttgcccatatctggttcctgaaatcgctgccgtcccgtatcggcctgctgatggacatgaccctgcgtgatatcgagcgcgttctctacttcgagagctatgtcgttatcgatccaggcatgaccaccctggaaaaaggccagctgctgaacgacgagcagtacttcgaagcgctggaagagttcggtgacgacttcgatgcccgcatgggtgccgaggctgtccgcgagctgctgcacgctatcgacctggagcacgagattggccgtctgcgcgaagagattccgcaaaccaactcggaaaccaagatcaagaagctgtccaagcgtctgaagttgatggaagccttccagggttccggcaacctgccagagtggatggtgctgaccgttctgccggttctgccgccagatctgcgtccgctggtcccgctggatggcggtcgtttcgcgacttccgacctcaacgatctgtatcgtcgagtgatcaaccgtaacaaccgtttgaagcgcctgctggatctgtccgctccggacatcatcgtgcgcaacgaaaagcgtatgttgcaggaagccgtcgacgcactgctcgacaacggtcgtcgtggccgcgctatcaccggttccaacaagcgtcctctgaaatctctggccgacatgatcaagggtaagcaaggtcgtttccgtcagaacttgctcggtaagcgtgttgactactccggtcgttcggtaattaccgtaggtccgaccctgcgtctgcaccagtgcggtctgcctaagaaaatggctctcgagctgttcaaaccgttcattttcggcaaattggaaatgcgtggcctggccaccaccatcaaagccgcgaagaaaatggtcgagcgcgagctgccagaggtctgggacgttctcgccgaagtgattcgcgaacacccagtgctcctcaaccgtgcaccgacccttcaccgtctgggtatccaggcgtttgagccagtactgatcgaaggtaaggctatccagctgcaccctctggtctgtgctgcgtacaacgccgacttcgacggcgaccaaatggccgtgcacgtaccgctgacactggaagcccagctggaagcgcgtgcgttgatgatgtcgaccaacaacatcctgtcgccagccaacggtgagccaatcatcgttccgtcgcaggacgttgtattgggtctgtactacatgactcgtgaagcgatcaacgccaagggcgaaggtcgtgtgttcgcggatctgcaggaagttgaccgtgtattccgtgccggcgaagccgcgctgcatgccaaggtcaaggtgcggatcaccgaaaccgtcaatgaccgtgatggcggcagcgtgaccaacactcgtatcgtcgacaccactgtcggccgtgcgctgttgttccaggttgtgccaaaaggtctgtcgtacgacgttgtcaacctgccgatgaagaaaaaggcgatctccaagctcatcaaccagtgctaccgcgtggttggtctgaaagagactgtgatcttcgctgaccagttgatgtacaccggttttgcctactcgactatttccggcgtttccatcggtgttaacgacttcgttatcccggatgagaaagcccgcatcatcggtgccgccaccgacgaagtgaaagagatcgagagccagtacgcctccggcctggtaacccagggcgagaagtacaacaaagtgatcgacctttggtcgaaagctaacgacgaagtatccaaggcgatgatggccaacctctcgaaagagaaagtcatcgaccgtcatggcgacgaagtcgagcaagaatccttcaactcgatgtacatgatggccgactcgggtgcgcggggttccgcagcacagattcgtcagctggccggtatgcgtggtctgatggccaagccggacggttccatcatcgaaacgccgattactgcgaacttccgtgaaggtctgagcgtactccagtacttcatctcgactcacggtgctcgtaaaggtctggcggataccgcgttgaaaactgcgaactccggttacctgactcgtcgtctggtagacgtggcgcaggatctggttgtaaccgagatcgactgtggcaccgagcatggcctggtaatgactccgcacattgaaggcggtgacgttgtagagccgttgggtgagcgcgtgttgggtcgtgttattgcccgtgacgtattcaagccaggtaccgaggacgtcatcgttcctgccggcactctggtcgacgagaagtgggtcgagttcatcgagttgaacagcatcgacgaagtgatcgtgcgttcgccgatcagctgcgaaacccgctacggcatttgcgccaagtgctacggccgcgacttggctcgtggtcaccaggtgaacatcggtgaagctgttggcgttatcgctgctcagtccatcggtgagccgggtacccagctgacgatgcgtacgttccacatcggtggtgcggcaagccggacctccgcggccgacagcgttcaggtgaagaacggcggtaccgtccgtctgcacaacctgaagcacgttgagcgagtggatggtcacctggttgctgtgtcccgttccggcgagctggcgatcgctgacgacttcggtcgtgagcgtgagcgttacaagctgccgtacggtgctgtgatttcggttaaagaaggtgacaaggtcgacgctggctctatcgtggccaagtgggatccgcacactcacccgatcgttaccgaaatgaaaggtaccgtgacctacgtgggcatggaagaaggcatcacgatcaagcgtcagactgacgaattgaccggtatgaccaacattgaagtacttgacgcgaaagatcgtccagctgccggtaaagacatccgtcctgccgtgaagatggtcgacgataacggcaaggatctgttgctgccaggcactgacgtaattgctcagtacttcctgccagccaacgccctggtcggtgtagcggacggcgcgaagatcgcgatcggtgatgttatcgctcgtatcccgcaagaaacttcgaagacccgcgacatcaccggtggtctgccgcgtgttgccgacttgttcgaagctcgtcgtccgaaagaagcatcgattctggctgaagtcagcggcaccatcgcgttcggtaaagagaccaagggcaagcgccgtctggtcattaccccgaacgacggtagcgatccgtacgaagagctgattccgaagtggcgtcacctgaacgtcttcgaaggcgaacaggtaaaccgcggcgaagttatctccgacggtccaagcgatccacacgacatcctgcgtctgctgggtgtgagtgcgctggccaagtacatcgtgaacgagatccaggacgtttaccgcctgcagggcgtgaagatcaacgacaagcacatcgagaccattctgcgtcagatgctgcgtaaggttgagatcgctgaatccggcgattccagcttcatcaagggcgaccagatggagctgactcacgtattggtagagaacgagcgtctgaacaccgaagacaagtttgtcgccaagttcacccgcgttctgctgggtatcaccaaggcgtcgctgtcgaccgaatcgttcatctcggcggcctctttccaagagaccactcgcgtactgaccgaagcggcggtaaccggcaagcgcgattacctgcgcggcctgaaagaaaacgtggtcgtgggtcgcctgatcccggctggtactggcctggcctatcacagtgagcgtaagcgtcgccgtgatgcagacaagcctctgcgcgtaagcgcaagtgaagttgaagctgcactgaccgaagcgctgaactccagcggtaactgaggtctgcagtagattgagatagggccccggcttttccgctcacgaatcaagacgattttgtcggggttcgctgataggggaggccggggccttgccttgactggggacaagatcctctttagactcttgtacccctaaatttggtggggcttgcgccctgccattttgtttatgtcgaaagacaacagtggagctagtagatggcaactatcaaccagctggtacgtcagccgcgtaagcgtatcgtcgagaaatccgacgtgcctgcgctgcagaactgcccgcaacgtcgtggcgtgtgcactcgcgtgtataccactacgccgaaaaaacctaactcggcactgcgtaaagtatgccgtgtgcgtctgaccaacggtttcgaggtttcctcgtacatcggtggtgaaggccacaacctgcaagagcacagcgtggtactgatccgcggcggtcgtgtaaaagacttgccaggtgttcgttaccacaccgttcgcggctccctggatacctccggcgttaaaggtcgtaaccaaggtcgttcgaagtacggtaccaagcgtccgaagtaatcggccgttttgcagttaattattttattgagtcgataagagtaaggtcgggcacgagtcctttggatcaactgtcccgagctaacctgaagaccgtttgagggcttatcatgccaagacgtcgcgtagcagccaaacgtgagattctggacgatccgaaatacggaagccagatcctcgccaagttcatgaaccacgtaatggaaagcggcaagaaagccgttgccgagcgtatcgtttatggcgcgctggaaaaagttaaagaacgcaagaacagcgatcccctggaaatcttcgagaaagctctcgacgccatcgctccgctggtcgaagtgaagtcgcgccgtgttggcggtgctacttaccaggttccggtcgaagttcgtccgtcccgtcgtaacgctctggcaatgcgctggttggtagacttcgcccgtaagcgcggcgagaagtctatggctctgcgcttggctggcgaactgctggatgctgccgaaggcaagggtgctgcagttaagaagcgtgaagatgtacaccgtatggctgaagccaacaaggctttctcgcactaccgcttctaatatcggcatcattcattttgcgagggctttatggctcgtactacagcaatcaaccgctaccgtaacatcggtatctgtgcccacgttgacgcgggcaagactaccactaccgagcggatcctgttctacacaggtctcagccacaagatgggtgaggtacatgacggcgctgctaccaccgactggatggtgcaggagcaggagcgtggtatcaccattacctctgctgctgtaactaccttctggaaaggttcgcgcggccaatacgataactatcgtgtaaacgttatcgataccccgggccacgtagacttcaccattgaagtagagcgttcgctgcgcgtactcgacggcgcggtcgttgtgttctgcggtacttccggtgtcgagcctcagtccgaaaccgtatggcgtcaagccaacaaatacggcgttccacgtgttgtttacgtgaacaagatggaccgtgccggtgccaacttcctgcgtgttgttgctcagatcaaaaaccgtctgggtcacactccggttccagttcagctggctatcggtgcagaagataacttcgaaggtcagatcgatctgatcaagatgaaggctatctactggaacgacgacgacaagggtactacctatcgcgaggaagaaattcctgccgatatgctggacctggctaacgagtggcgctccaacatggttgaagctgctgccgaagccaacgaagagctgatgaacaagtaccttgaagaaggtgagctgactgtcgaagagatcaaggcaggcctgcgcgcgcgcaccctggccagcgagatcgttccggctgtctgcggttcctcgttcaagaacaagggcgttccgctggttctcgatgctgtcatcgactacctgcctgctccgaccgagatccctgcaatccagggtatccatccggacaacatcgacgacgaaaacgctccgaaaatcgagcgtcacgccgacgacagcgaaccgttctcggctctggcgttcaagattgctactgacccgttcgtgggcaccctgactttcgtgcgcgtttactcgggcatgctgcagtctggcgactccgtgatcaactcggtcaagggcaagaaagagcgcgttggtcgtatggtgcagatgcacgccaaccagcgtgaagaaatcaaggaagtgctcgcgggcgacatcgctgcgctgatcggcatgaaggacgtcaccaccggtgacaccctgtgtgatgccgccagcccggttatcctcgagcgtatggacttccctgagccggtgatttcggtggccgttgagccgaaaaccaagcaagaccaggagaagatgggtattgcactgggcaagctggctcaggaagacccgtcgttccgcgtcaagactgacgaagaaactggtcagaccatcatctcgggtatgggtgagcttcacctggacatcctcgttgaccgcatgaagcgcgaattcaacgtcgaagccaacatcggtaagccgcaggtttcctaccgcgagaagatcaccgtcggctgtgaagttgaaggtaagttcgttcgtcaatccggcggtcgtggccagttcggtcattgctggatccgttttgctccggcagacgtcgacgaaaaaggcaatatcactgaaggtctggtgtttgccaacgaggtcgttggtggtgtggttccgaaggaatacatcccggcaatccagaagggtatcgaagagcagatgaagaacggcgttgtcgccggctatccgctgatcggcctgaaggctaccgtgtttgatggttcttaccacgacgtcgactctaacgagatggcgtttaaggtagcggcctccatggcgaccaagcagctgcgtgagaagggcaagggcgtagttcttgagccgatcatgaaggttgaagtagtaacccctgaggactacatgggtgacgtgatgggtgacctgaaccgtcgtcgtggtctgatccagggtatggaagactcggtctctggcaaggttatccgtgctgaagtgccgctgggtgaaatgttcggttatgcgaccgacgttcgttccatgtcccagggtcgcgcgagctactccatggagttctccaagtacgccgaagctccgtcgaatatcgtcgaagcactcgttaaaaaacaaggctaatccagccctttaggcaagaggttcactgtcgtggctaaagaaaaatttgaacgtaacaaaccgcacgtcaacgttggcaccatcggtcacgttgaccacggtaaaaccactctgaccgctgctctgactcgtgtttgctccgaggttttcggttcggctcgcgttgacttcgacaagatcgacagcgccccggaagaaaaggctcgtggtatcaccatcaacaccgcgcacgtagagtacgactcgaacattcgtcactacgcgcacgttgactgcccaggtcacgccgactacgtcaaaaacatgatcactggtgctgcccagatggacggcgcgatcctggtttgctcggctgccgatggtccgatgccgcaaactcgcgagcacatcctgctgtcccgtcaggtaggcgttccgtacatcgttgtcttcctgaacaaggctgacatggtagacgacgctgagctgctggaactggttgagatggaagtgcgcgacctgctgagcacttacgacttcccaggtgatgacactccaatcatcatcggttcggctctgatggctctgaacggccaagacgacaacgaaatgggcactaccgctgttaagaagctggtagaaactctggatacctacatcccagagccagagcgtgctatcgacaagccgttcctgatgccaatcgaagacgtattctcgatctccggccgcggcaccgtggtaactggtcgtgttgagcgtggtatcgttcgcatccaggaggaagttgagatcgttggtctgcgcgacactcagaaaaccacctgcaccggtgttgagatgttccgcaagctgctggacgaaggtcgtgctggtgagaactgcggcgttctgctgcgtggcaccaagcgtgacgacgttgagcgtggtcaggttctggttaagccaggtaccgttaagccgcacaccaagttcactgctgaagtgtacgttctgagcaaagaagaaggcggccgtcatactccgttcttcaaaggctaccgtccacagttctacttccgtactactgacgtgactggtaactgcgagctgccagaaggcgttgaaatggtaatgccaggtgacaacatccagatgactgtcactctgatcaaaaccatcgcgatggaagatggtctgcgtttcgctatccgtgaaggcggtcgtaccgtcggcgctggcgtcgtagccaaagtcatcgagtaatcgacgactcatgaaaaagcccccgcttgcgggggcttttttattgggttgacactctgtggggccgtctatagaattgcgcctccttttaacgggcgtattgcgcccggtgggaatagcagcctggagtctgaaatccaatgcaaaatcagcaaatccgtatcaggttgaaggctttcgaccatcgcctgatcgaccaatccacccaggaaatcgtggaaaccgcgaaacgtactggtgctcaagtgcgtggtcctattccactgcctacccgtaaagagcggttcaccgttctggtctccccgcacgtcaacaaagacgcgcgtgaccagtacgagatccgtactcataagcgcgtactggacatcgtccagccaacggataaaaccgttgatgctcttatgaagcttgatcttgcggcaggtgtggaagtgcagatcagcctcggctaagactcggtcttagtcgtgtaacgctctgaaatgggcggccatagcgggtgaaagccccgtacactcatgaggtttacaacatgactattggtgtagtcggtcgtaaatgcggtatgacccgtattttcaccgaagaaggtgtctccattccggtcacggtcattgagatcgagccgaatcgcgtcacccagttcaaaactgaagaaaccgatggctatcgtgcagtgcaagtcactgtaggtgagcgtcgtgcttcgcgcgtgactgctgctcaagcaggtcacttcgctaaagcgaacgttgctgccggtcgtggcgtttgggagttccgccttgaagaaggcgagtaccaagctggcgatctgatcaatgcagaaatcttcgcagctggccaactggtagatgttaccggtcagtcgaaaggtaaaggcttcgccggtaccatcaagcgttggaatttccgcggtcaagataacacccacggtaactccgtttcccaccgcgtcccgggctctattggccagtgccagactcctggtcgtgtattcaagggcaaaaaaatgtccggtcatatgggcgctgagcgcgtgaccgtgcagtccctggaagtagtgcgcgtcgacgctgaacgcaatctgttgttggtcaagggtgctgttcctggcgctactggcggcaacctggttgtacgtccggcggccaaggctcgcggttaaggggaagctgacatgcaattaaatgtaaatgacgctcaagcgatcgaagtttccgaactgacatttggcggcgaattcaacgagacgctggttcaccaagcagtcgtggcctacatggccggcggccgtcaaggtagcaagcagcaaaagacccgttccgacgtttccggtggcggcaagcgcccatggcgtcagaaaggtactggccgtgctcgtgccggtactatccgtagcccaatctggcgtggcggcggtaccactttcgcagctcgtccacaggatcactcccagaagctgaacaagaagatgtatcgcgcagcaatgcgttccatccttgctgagctggtacgtactgatcgtctggtcgtggttcaggatttcgctgttgaaactccgaaaaccaaagatctgctgggcaagctgaacaacatgagtctgaccgacgttctgatcgtgtctgacgctgttgatcagaacctgtacctggctgctcgtaacctgccacacgttgatgtacgtgacgtgcaaggttccgatccagttagtctgatcgcatacgacaaagtgttgatcactgtgtcggccgtgaagaaattcgaggagctgctgggatgaaccaggaacgcgtatttaaagttctgcttggcccgcacgtttccgagaaggctacggttctggcagacaagaaaggccagttcgttttcaaggttgctactgatgcaaccaagctggaaatcaagaaggccgtcgaaagcctgttcagcgtgaaagtggagcgcgttgctaccctgaacgttctgggtaagagcaagcgtaccgctcgcggtctgggcaagcgtaatgactggaagaaggcagttatctcccttcagccaggccaagatctcgatttcagcagcagtgctgagtaaggaaggggtgcatcatggcaatcgttaaatgcaaaccgacttcccctggccgccgttttgtggtcaaggtggtcaaccaggagctgcataaaggcgctcctcacgcaccgctgctcgagaagaaatcgaagtctggtggtcgtaacaacaatggccgtattaccactcgtcacgttggtggtggtcataagcagcactaccgtctggtcgacttccgtcgcaacgacaaagatggcatcgctgccactgtcgagcgtatcgaatacgatccaaaccgtactgctcacatcgctttgctgctgtacgcagacggcgagcgtcgctacatcatcgcccctaaaggcgtgagcgctggcgaccagctgatcgcaggtgctctggcaccgatcaagccgggcaacgctctgcaactgcgtaacattccagttggtagcaccgtacacggcatcgaactgaagccaggtaaaggcgcgcaaatcgctcgttccgctggtgcttcggctcagctgatcgctcgtgaaggtgtctacgtgaccctgcgtctgcgttctggtgagatgcgtaaagtcctggctgaatgccgtgcgaccctgggcgaagtctcgaactccgagcacagcctgcgttcgctgggtaaagctggtgccaaacgctggcgtggcgttcgcccaaccgttcgtggtgttgccatgaacccggttgaccacccacatggtggtggtgaaggtcgtacctctggtggtcgtcatccggtatcgccatggggcttcccgactaagggcgcgaagactcgtggtaataagcgtaccgacaaaatgatcgtccgtcgtcgcaagtaaatagagggatacgacagtgccacgttctctgaaaaaaggtccttttattgatcttcacctactgaagaagatcgaagtggcggcggaaaagaacgatcgcaaaccagttaagacctggtcgcgtcgttccatgatcctgccacaaatggtcggtctgaccattgctgtgcataacggtcgtcaacatgttccagttctcgtgaacgaagacatggtcggccacaaactgggcgagttcgccggtacccgtacatatcgcgggcacgtggctgacaagaaagccaagcgttaaggggtaaggaacgatggaagtagccgctaagttgtcgggcgctcgaatctccgcccagaaagcccgcttggtcgccgaccagatccgcgggaagaaggtgggcgaagcgctcaacctgttggctttcagcagtaagaaagccgccgagatcatgaagaaagtgctggagtcggccgtagccaacgccgagcataacgaaggcgcagacgttgatgacctgaaggtctccaccgttttcgtcaacgaagggcgttcgctgaagcgcatcatgccacgtgccaaaggccgtgctgatcgcatcgtcaagcggtcttgccatatcactgtcaaggttgctgacaagtaacggagtcgaagagatgggtcagaaagtacatcccattggcattcgcctgggaatcgtcaaggagcacacctccgtctggtacgcagacggtcggacttatgcggactatttgctcgcagatctgaatgtgcgtgagtacctccaagacaaactaaaaagcgcgtccgtaagccgtatcgatatccatcgtccggctcaaactgcacgcatcaccatccacaccgctcgtcccggcatcgtgatcggcaagaaaggtgaagatgttgagaaactgcgtcaggacctgaccaagcaaatgggtgtgcctgtgcacatcaatatcgaagagatccgcaagccggagctcgacggtatgctggttgcccagagcgtagctcagcagctggagcgtcgcgtaatgttccgtcgcgctatgaagcgcgcagtacagaacgccatgcgcattggtgccaaaggcatcaaaatccaagtgagcggtcgtctcggcggtgctgaaatcgcacgtactgaatggtatcgcgaaggtcgtgtgccactgcacaccctgcgtgccgatatcgactatgccacctacgaagctcacaccacttacggtgtgatcggtgtgaaggtttggatcttcaaaggcgaagtaattggtggtcgccaagaagagctgaagccacaagcacctgcgcctcgtaaaaaagctgctaagtaaggggtacgccaaatgttgcaaccaaagcgtacgaagttccgcaagcaaatgaccggccacaaccgtggtctggcattgcgcggtagcaaagtcagcttcggcgagttcgcgctgaagtctgttgctcgtggtcgtctcaccgctcgtcagatcgagtcagcgcgtcgtgctctgacccgtcacgtaaaacgtggcggcaagatctggatccgtgtattcccggacaagcctatttccaagaagccactcgaagttcggatgggtaaaggtaagggtaacgtcgaatactgggttgcccagattcagccaggcaaagtcctgtatgaaatcgagggtgtttctgaagagctggcgcgtgaggctttcgccctggctgctgcaaagctgccgctcgccacctcctttgttaaacggacggtgatgtgatgaaagcgaatgaacttcgtgaaaaatccgcacagcagctgaacgagcaactgctcggcctgctgcgcgaccagttcaatctgcgtatgcagaaggcaactggccagttggggcagtctcatctgctctcgcaagttaagcgtgacatcgctcgcgtgaagactgtgctcaaccagcaggcaggtaagtaatcatggctgaagccgaaaaaactgtccgtacgctgactggccgtgttgtcagcgacaagatggacaagaccatcaccgttctgatcgagcgtcgcgttaagcaccctatctacggtaaatacgttaagcgttcgactaagctgcacgcgcacgacgaaaccaaccagtgccacatcggcgacaaagtcactattcgtgaaactcgtccgatggccaagaccaagtcttgggctctggttgatgttctcgaacgcgctgtggaagtctaagggctaagggtcggagaaattatatgattcagactcaatccatgctcgatgtggccgataacagcggcgctcgccgcgttatgtgcatcaaggtgctgggtggctcccatcgtcgttacgctggtatcggtgacatcatcaaggttaccgtcaaggaagcaattcctcgcggtaaggtgaagaaaggtcaagtgatgactgctgttgtagtccgcactcgccatggcgtccgtcgtgctgacggctccatcatccgctttgatggcaacgctgctgttctgttgaacaacaagcaagagccgatcggcacccgtatctttgggccagtgacccgtgaacttcgtactgagaagttcatgaagatcgtctcgctcgccccagaagtgctgtaaggagatccgacatgcaaaagattcgtcgtgacgacgagatcatcgtgatcgccggcaaagacaagggtaagcgcggtaaggtgcttaaggttctcgctgacaaccgtctggttgttggtggtctgaacctggttaagcgtcataccaagcctaacccgatgtcgggcgtacagggcggtatcgtcgagaaagaagcgccactgcacgcttccaacgtcgccattttcaacggcgaaaccaacaaggctgaccgcgttggtttcaaagtagaagacggcaaaaaaattcgtgtcttcaagtcgacccaaaaagcggttgatgcttgaacactgctaggtagaagaccatggcacgactacaagagatttaccggaaggaaatcgctccgaaacttaaggatgaacttaagctttcgaacgtgatggaagttccgcgcgttaccaaaatcaccctgaacatgggtctgggcgaagcgatcggcgacaaaaaagtcatcgagcacgctgttgctgacctggaaaagatcaccggccagaaagtcgttgtgacctacgctcggaaatccatcgctggctttaaagtccgtgaaggttggccgatcggcgtcaaagtgaccctgcgtcgtgagcgtatgtacgagttcctggatcgtctgctgtcgatctccctgcctcgggttcgcgacttccgcggcctgaatgccaagtccttcgacggtcgtggcaactacagcatgggcgtgaaagagcagatcatcttcccggaaatcgactacgacaagatcgatgctctccgcggtctggacattaccctgaccaccactgccaagaacgatgatgaaggccgcgctctgctgcgtgctttcaaattcccgttccgcaactgattggagtaggaaaatggccaagaagagcatgaaaaaccgtgagctgaagcgtcagctcaccgttgccaagtacgccaccaagcgtgcagcgctgaaagctatcatcgtcgatctgaacgcaagtccagaagcgcgttgggaagctaccgtagctctgcagaagcagccacgtgacgcaagcgcttcgcgcatgcgtaaccgctgccgcctgactggtcgtccgcacggcgtttaccgcaagttcggcctcggccgtaacaagctgcgtgaagctgcaatgcgtggtgacgtaccaggtttggttaaagccagctggtaatagctatcaaagtctcggtgctcggggtcgcaagatcctgaccgccggtggccttgaacatgaatcaagccccttttggggcttgattcatttctggggggtgtctagaatgaccggctcgcctgagcccgtgttttttgcccggaatttctcggcgacaagctgtagccgcaaggctcattttttttgtatcaggagcgtctagcccatgagtatgcaggacccgttagcggacatgctaactcgaatccgtaatgcccagatggctgaaaagtccgtcgtaagcatgccgtcttccacgctgaaggtggctgtagcaaaagtcctgaaggacgaaggttacatcgcgggttatcagatcagcagcgaaaccaagccactgctgtccatcgagctgaaatacttcgaaggccgtccggtcatcgaggaagtgaagcgcgttagccgtccaggcctgcgtcagtacaagtccgttgaagatctgccgaaagttcgtggcggtctcggcgtgtctatcgtctccaccaacaaaggtgtgatgactgatcgtgctgcgcgcgctgccggtgtcggcggcgaagttctttgcactgtgttctaaggggggataagcatgtctcgcgtcgctaagaaccccgttaagctgccagctggtgttgaagttaaattcgccggccaacagctttcggtgaagggtgccaagggcactctcgaactgaacgtacactcgtccgttgaaattgttcaggaagctggtgagctgcgtttcgctgctcgcaatggcgaccaacaaactcgcgcaatggccggtaccactcgtgcgttggtaaacaacatggtccaaggcgtaagccaaggcttcgagcgcaagctccagctggtcggtgttggttacaaggcacaagcaaaaggcacagtgctgaacttggcccttggcttctcgcatccagtggactacgagctgccggaaggcatcaccgctgagactcctagccagaccgatatcctgatcaggggcatcgacaagcagctggtaggtcaagtggccgctgagatccgcgacttccgtccgccagagccttacaaaggtaaaggtgtgcgctacgcggacgaagtcgtccgtcgtaaagaagccaagaagaagtagggcatagcaaatgaccgacaaaaaagttactcgactgcgtcgcgctcgcaaagcacgcctgaaaatgcacgaactcgaagtcgtgcgtctctgcgtgttccgctcttcgcagcacatctacgcccaggtcatttcggccgacggcaacaaggtcctggcaagtgcctcgactttggataaagaactgcgtgatggcgccactggcaacatcgacgcggccactaaggttggccagctggtcgctacgcgtgcaaaagccgctggcgtctcgcaggtggctttcgaccgctctggcttcaagtaccacggccgcgtcaaggcgctggctgatgctgctcgtgaagctgggctggagttctaagttatgtcaaataacgaccaaaagcgcgacgaaggctacattgagaagctggttcaagttaaccgcgtagccaaaaccgtaaaaggcggccgtatcttcactttcaccgcgttgaccgtggttggtgatggtaaaggtcgcgttggcttcggccgtggcaagtcgcgtgaagtgcctgctgcgatccagaaggcaatggaagctgctcgccgcaacatgatccaagttgatctgaacggcactaccctgcagtacgcaatgaagtccgctcacggtgcttcgaaggtgtacatgcagcctgcttctgaaggtaccggtatcatcgctggcggcgctatgcgtgctgtcctcgaagttgctggcgttcagaacgttctggccaagtgctacggctcgactaacccagtaaacgtggttcacgccactttcaagggtttgaaagcaatgcagtcccctgaatccattgccgccaagcgtggcaaaagcgtccaggagatcatctgatcatggctaccgttaaagtaacgctgatcaaaagcatgaccggccgtatccctaaccacaaactgtgcgttaagggtctgggtctgcgtcgcatcggtcacactgtagaagtccaggatactcccgagaaccgcgggatgatcaacaaggcttactacatgctgcgtgtcgagggttaatcgatgaaactcaatgatctgagtccagcgccgggttcccgtcgcgaaaagcatcgtccgggccgtggtatcggtagtggtttgggtaagactggtggccgtggtcacaaaggtcagacttcccgctccggtggcaccattgctccaggctttgaaggcggtcaacagccgctgcatcgtcgtctgccaaagttcggtttcgtatccctgaaggccatggaccgcgcagaagtgcgtctgtccgagctggctaaagtggaaggcgacatcgtcaccgtgcagtccctgaaagatgccaacgtgattaaccaaaacgtacagcgtgtgaaaatcatgctgtccggcgaagttactcgcgctgtgactatcaagggcatcgcagccaccaaaggtgcgcgtgcggctatcgaagcagctggcggcaagttcgaggaataaatggctaagcaaggtgctctctctgcgctcggcaaaggcggtatgtctgaactctgggctcgtctgcgttttctgttcttggcgattatcgtctaccgaataggcgcacacatcccggttccaggtatcaaccctgaccgactcgcagacctgtttcgacagaatgaggggaccattcttagcttgttcaacatgttttccggcggcgcgctggaacggatgagcatctttgcactggggatcatgccgtacatctcggcatcgatcatcatgcagctgatgaccgccgtcagcccgcagctggagcagttgaagaaggaaggtgaagctggccgtcgcaagatcagccagtacacccgctacggcactgtcgtcctagctcttgttcaggccatcggcatgtccgttggcctggcggggcagggcgttgcgttcactggtgactttggcttccatttcgtcgcggtatccacttttgtggctggtgcgatgttcatgatgtggctgggtgagcagattactgagcgtggtgttggcaacggtatctcgatgttgattttcgcaggtatcgtcgccggtcttccgagagcgatcgggcagtctttcgagtctgcacgtcagggtgatatcaacatttttgccctggttgccatcggtttgctggcagtagcgattatcggttttgtggtgttcattgagcgtggccagcgtcgtattgctgttcactatgccaagcgtcagcagggccgcaaggtgtttgctgcgcagactagccacttgccgctgaaagtgaatatggcaggcgttattcctgctattttcgcgagcagcattttgctgttcccggcttcgttgggtgcctggttcggtcagtctgaaggtatgggctggttgcaggacatctcgcagtcgatcgctcctggtcagccgttgaatattctgctgtttagtgcagggattattttcttctgcttcttctatacggcgttgatgttcaatccgaaagacgtagcggaaaacctgaagaagtccggtgcctttattccgggcatccgtccaggtgagcagtctgcgcgctacattgatggcgttctgacccgcttgaccatgttcggtgctctatatatgacggccgtctgcctgttgccccagttcctggtggttgcagcaaacgttccgttctaccttggcgggacctcgttgctgatcgtggtcgtggttgttatggactttatgtcgcaagtacaatcgcacctcgtttcgcaccagtacgaatccctgatgaagaaagccaacctgaagggttacggcagcggcatgctgcgctgacccataaggttcgaggagttggtgatgaaagttcgtgcatcggtgaaaaagctgtgccgtaactgcaagattattcgccgcgaaggtgttgttcgagtaatttgcagcgcggaaccgcgtcacaaacagcgccaaggctgagtgtgattgtgcttcaagcccagcagctagtgcgctgctgggttgattatttgttattacagcgatattatctcgcgccctatttcttggcttccggggcgtaggtagctgtcaattggagtcccactgaatggcccgtattgcaggcgttaacattccagataacaagcatactgttatctcgctgacctacatctatggtgttggtcgcacgactgcgcagaaaatctgtgcagagactggggtcaacccagccgcaaagatcaaggatctgagcgacgagcaaattgaacagctgcgtggcgaagtggcgaagttcaccactgaaggtgacctgcgtcgcgaaatcaacatgaaaatcaaacgcttgatggatctgggctgctaccgcggtctgcgccatcgtcgtggtcttccagtgcgcggtcagcgtaccaagaccaacgcgcgtactcgcaaaggtccgcgtaagccgatccgcaagtaatcgcaccagcgaatcgacaggaatttagtcatggcaaaacctgctgctcgtcctcgtaaaaagattaaaaagacagtggttgatggcatcgcccacatccacgcgtctttcaacaacaccatcgtgaccatcaccgaccgtcaaggtaacgctctttcctgggcaacctccggtggttcgggtttccgcggttcccgcaagtccaccccgttcgctgctcaagtagctgctgagcgtgctggtcaagctgcgctggaatatggcctgaaaaacctcgacgttaacgtcaagggcccaggtccaggtcgtgaatccgcagtccgcgctttgaacggctgtggctacaagatcgccagcatcaccgacgtgacgccaatcccgcataacgggtgccgtccgccgaagaagcgccgcgtgtaatccaggagattgtaaagaatggctcgttacattggtccaaaatgcaaactggctcgtcgcgaaggcaccgatctcttcctgaagagcggcgtgcgcgctatcgaatccaagtgcaacatcgaagcagcacctggtatccacggccagcgccgcggtcgccagtccgactacggcacccaactgcgtgaaaagcagaaggtccgtcgtatctacggcgttctcgagcgtcaattcagcggctactacaaagaagctgctggcaagaagggtgcaaccggtgaaaacctgctgcaactgctcgaatgccgtctggacaacgttgtataccgtatgggcttcggttcgactcgtgccgaatcccgtcagctggtatcgcacaagtcgatcagcgtaaacggtcagaccgttaacgttccgtcctaccaggttcgtgctggtgacgtggttgctgttcgcgagaaagcaaaaaaccaacttcgcattgtccaagctctcgatctgtgtgcccaacgtggccgcgtagaatgggtagaagtagacactgagaagaagtcgggcgttttcaagaacgttccagctcgcagtgatctgtccgccgacatcaacgaaagcctgattgtcgagctctactccaagtaagggctagaaaataggtgcatccatgcagatttcggtaaatgagttcctgacaccccgccatattgatgtgcaggttgtcagtccaacccgcgccaagatcaccctcgagcctctcgagcgtggttttggccacaccctgggcaacgcgctgcgccgcatcctgttgtcctcaatgcccggctgtgcagtagtcgaggccgagattgacggtgtgctccacgagtacagcgccatcgaaggtgtacaggaagacgtaattgaaatcctgttgaaccttaaaggtctggctatcaagctgcacggccgtgacgaagttacgctgaccttgtcgaagaagggttcgggggtggttaccgctgccgatattcagctggatcatgatgtcgagatcgttaaccccgatcacgtaatcgctaacctggcgtctaacggcgccctgaacatgaagctcgtagtagctcgtggtcgtggttatgaaccggcagactcgcgtcagagcgatgaagacgaaagccgcagcatcggtcgcttgcagcttgactcttcgttcagcccggttcgccgtatcgcatacgtggtggaaaacgcccgtgttgagcagcgtaccaacctggacaagctggttattgatctggaaaccaacggtactctggatcctgaagaggctatccgtcgtgctgcaaccatcctgcaacagcagttggctgcgttcgtcgacctcaaaggtgacagtgagccagtggtaatcgagcaggaagacgagatcgatccgatcctgcttcgcccggttgacgatctggaactgactgtacgttcggctaactgccttaaggcggaaaacatttactacatcggcgacctgattcagcgtaccgaagtagaactgttgaagactccgaaccttggcaagaaatccttgaccgaaatcaaggacgttctggcctcccgcggtctgtccctcggcatgcgcctcgacaactggccgcctgcaagtcttaagaaggacgacaaggcgactgcctgatcgtcgtaatcaccgaacgttgtgtttggtaaggaatgaaccatgcgtcatcgtaaaagtggtcgtcacctgagccgcaccagctcgcaccgcaaggccatgttccaaaacatggcggtgtcgctgttcgagcacgagctgatcaaaactacactgccgaaagctaaagaactgcgccgcgttgctgagccgctgatcactttggccaagacagacagcctggctaaccgccgtctggctttcgaccgtactcgttcgaaagctatcgttggtaagctcttcaacgacctgggcaagcgttacgctacccgtgagggtggctacctgcgcatcctcaagtgcggtttccgcgctggcgacaacgcgcctatggcgtacgtcgagttggttgatcgtgctgtcggcggtgaagctgtatccgctgagtaagacgtcaaatacaaagaaccgggcctagtgcccggttttttgtgtctgctgtattagaaaatctctatcgatagcaatcatttaatgcatttgatgctgtcatcttgatggtcgatactcctcgtcagccgattagccggcagttccaagactgacagaggaagattgagcatgagccaaaacaaaacgcttaccaccgcaagtggcgctccagtcgccgataaccagaattcccgttctgctggccctcgtggcccgctgctactcgatgattttcacctgatcgagaagcttgcccacttcaaccgtgaaaatattcctgagcgtcgcgtacacgccaagggctcgggtgcctatggcactttcacagtgacccgcgatatcaccgaatacaccagcgccaagcttttcgagtccgtgggtaagcagactcctaccttcctgcggttctccaccgtaggtggcgagcgtggttcggctgataccgaacgcgacccgcgcggttttgccctgaagttctataccgaagaaggtaactgggacatcgtcggcaacaacacgcctgtgttcttcattcgcgatccactgaagtttcccgactttatccacacccagaaacgtttgccgcagagcaacctgaagagcggccaggccatgtgggacttctggtcacactctcccgaggcgctgcaccaagtcaccatcctgttctcggatcgcgggattccggacggctatcgtcatatgcacggcttcggtagccacacctacagcttgatcaacgccaagggcgagcgtcactgggtgaaatggcactacaagacccagcagggcatcaagaacctggcaccggccgaggctgcccgcctggcgggtaccgatccggattacgcccaacgtgacctgttcaacgcgatcgagcgcggcgatttcccgaaatggagcgtatgcattcagatcatgaccgaggctgaggctgccgctcactacgagaacccgttcgacgtgaccaagacctggtcacagaaggagttcccgctgatcgaggtcggtgagctggaattgaaccgcaacccgctgaactacttcgcagaagtcgagcaggctgcctttggtcctagcaacatggttccaggcgtcggcctgtcgccggatcgcatgctgcaaggccgcgtattcgcttacgccgacgctcatcgctatcgtgtcggcaccaaccaccagcaactgccggtcaacgccccacgcagcccggtgaacagctaccagcgtgatggctccatggcctttggcagcaatggtggcgcggcaccgaactatgagccgaacagctacgctgatgcgccgaagcaggcccctcgctacgcggagccggccctggccctcagcggtgcggcggatcgttacgatcaccgcgaagataccgactactacagccatgcaggcgctctgttccgtttgatgaatgatcagcagcaagccctgttgatcaacaacatcgccggtgcaatggcgggtgtcagctcggatgtggtccagcgtcagctgcagcatttcttcaaggccgacccggcttatggagaaggaatcgcaaaggcgttgggcgtacagcttaactaagtctaaacgagaagcagaaccgccctcatttgggcggtttttgcgttttttcggctacttttctctgaaaatcttcactttgttagcgtttttccagtgacctgcaagtcagcttggttcaaaatacagactttcaagcagggagatgtagggcgatgcaaggtcacccggacgtaatcgattacctcaacacgttgctgacgggcgaactggcggcgcgtgaccaatatttcatccattcgcgcatgtatgaggactggggcttcagcaagctctacgagcgcatcaatcacgagatggaagaagagactcaacacgccgatgcattgatgcgtcgcatcctgatgctcgagggcacgccacgcatgcgccctgacgatctggatatcggcaccaccgtgccggatatgttcgccgccgacctgcgcctggagtacaaggtccgcgctgcactgtgcaaaggcatcgaactgtgcgagaagcacaaggactatgtcagccgcgacatcctgcgtgtgcagttggccgataccgaagaagaccatacctactggctggaaaagcagttgggcctgatcaaatcgatcggtctggaaaactatctgcagtcgcagttctgatgctttagccagcgcctgcaggcaaatgcaggactgacgagcacaaaaaagcccctgtcatttcacaatggcaggggctttttcattgggctcaggcccggtcgcgggtcagcagtggcttgaggtagtagccggtatgggattgcggcatttctgccaactgctccggcgtaccctcggcaatgatctgtccgcccttggaaccgccttccggccccaggtccaccagccagtcggcggtcttgatcacgtccaggttgtgctcgatcaccaccacggtgttgccgtggtcacgcaggcgatgcagaacgtccagcaactgctggatatcggcaaagtgcaggccggtggttggctcgtcgaggatgtagagggtcttgccggtgtcacgcttggacagctcgcgagacagcttgacccgctgcgcctcaccgccggacaaggtcgttgccgactgccccagcttgatgtaggaaagccccacatccatcagcgtctgcagcttgcgcgccagcgccggcaccgggtcgaagaactcccgcgcttcctcgatggtcatttccaggacctcgtggatgctcttgcccttgtatttgatctcaagggtttcgcggttgtagcgcttgctcttgcacacatcgcacggcacgtagatgtccggcaggaagtgcatttccaccttgatcaggccgtcgccctggcaggcttcgcagcgtccacccttgacgttgaaggagaagcggcccgggccgtagccgcgcgagcgcgactcgggtaccccggcaaacagttcgcggatcggcgtgaacagcccggtgtaggtcgccgggttggagcgcggggtgcgaccgatcgggctctggtcgatatccaccaccttatccaggtgctgcaggccgttgatgctgtcgtgcgcagcggcttccagcgtggtcgcgccgttcagcgccgtggcgctgagggggaacagggtgttgttgatcagggtcgacttgcccgagccggagacaccggtcacgcaggtcagcaggccgatcgggatctccaggtcgacgttgcgcaagttgttgccgcgagccccttttagggacagtgaaagcttcttgttgcgcggcgtacgcttggccggcacggcgattttcacgcgccctgacaggtatttgccggtcagcgagtcgggatgggacatcacctcgtcgggggtaccctcggcgacgatctgtccgccatgcacgccggcgcccgggccgatgtccaccacatagtcggccaggcgaatggcgtcctcgtcgtgttcgaccacgatcaccgtattgccgatatcccgcaggtgtttcagggtgcccagcaagcgatcgttgtcgcgctggtgcagaccgatggagggttcatcgaggatgtacatcacccccaccaggccggcgccgatctggctggccagacgaatacgctgcgcctcgccgccggacagggtatcggcgctgcgatccagggtcaggtaatccaggccgacattgaccaggaactgcaggcgctcgcggatttccttgaggatcttgtcggcaatctcgccacggcgtccggtcagagacaaagtgccgaagtaatcggtggcatcgccgatcggcagactggtaacggccggcaacgtcttctcgccgacccacacgtggcgggcttcgcgacgcaggcgggtgccgcggcaatccgggcacggctgggtgctgaggaacttggccagctcctcgcgcacggtggctgattcggtctcgcggtagcgacgttccaggttcggcactatgccttcgaacgggtgggagcgtttgacgatatcgccacgatcgttgaggtacttgaagtcgacgttctgcgtgccgctgccgttgagaatgaccttctgctggtcggccggcagctggttgaacggtacttccaggctgaagccgtaatgcgatgccagcgagccaagcatctggaagtaatagacgttgcgcctgtcccagccgcgaatcgccccttcggccagggtcagctcgccattgaccaggcgcttgatgtcgaagaactgcttgacccccaggccatcgcaggtcgggcaggcaccggccgggttgttgaaggagaacagcttgggttccagttcgctgatggcgtggccacagatcgggcaggcgaagcgcgcggaaaagatgatttcttcaccgggttcgtcgtccatcggcgccaccagggcgataccgtcggccagcttcagcgcggtctcgaaggactcggccagacgctgctgcaggtcggcgcggaccttgaagcggtcgaccaccacatcgatcgagtgcttcttctgtttatccagcttcggcagctcatccagctcgtagagcttgccgttgacccgggcgcggacgaagccctgggcgcgcagttcctcgaagaccgacaggtgctcgcccttgcgctcgcgaatcaccggcgccagcagcatcagcttgctgccttccggctgggccagcaccaggtcgaccatctggctgacggtctgggcttccagcgggatgtcgtgatccgggcagcgtggcgtacccacgcgcgcatacagcaggcgcaggtagtcgtagatctcggtgatggtgcccacggtggagcgcgggttgtgcgaggtggatttctgctcgatggaaattgccggcgacaaaccttcaatggtgtcgacgtcgggtttttccatcatcgacaggaattgccgggcataggccgacagcgactcgacataacggcgctggccttcggcgtacagcgtatcgaacgccagggacgatttgccggatccggacaggccggtgatgacgatcagtttgtcccgtggcagggtcaggtcgatgttcttcaggttgtgggttcgggccccacgaatcaggatcttgtccaaagtggcctcgctcggcgggcgtcgaaaacgtaggagtataagggcaaatactggatggatgcacactatcaaatgaggtctgtgcagccgtagatgaaacctgcgcggcaaagcgtcgccatataccccgtcaatcgatcggactggtagaatcgccgccggttcacacgaggtttttccatgcatgatccccacagcgagcgcatgagtggcgccgagacccgcgcggcaagcggtctggccctggtgttcgccttccgtatgcttggcatgttcatggtgttgccggtcctggcgacctatgggatggacctggcgggagcgaccccggccctgatcgggttggcgatcggcgcttacggcctgacccaggcgattttccagatcccgttcgggatcatttccgaccgcatcggccgtcgtccggtgatttacctggggctaatcgtctttgccctgggcagtgtgctggcggccaacgccgattcgatctggggcgtgatcgccgggcgcatcctgcagggcgccggggcgatttccgcggcggtcatggcgctgttgtcggacctgacccgcgagcagcaccgcaccaaggccatggccatgatcggcatgaccatcggcctgtcctttgccgtggccatggtggccggtccgctgctgacccgcgctttcggcttgcccgggctgttcttcgccaccggcggcatggcgctgctgggcatttttatcgtcgccttcatggtgccgcactcgaccggcccgttgcagcaccgcgaatccggggtcgcgcgccaggccctgctgccgacgctcaagcacccggacctgctgcgcctggatcttggtatcttcgtgttgcacgcaatgctgatgtcgagcttcgtcgccttgccgctggccctggtggaaaaagccggcctgcccaaggaacagcactggtgggtctacctcaccgcgctgttgatctccttcttcgccatgatcccgttcatcatctacggcgagaagaaacgcaaaatgaaacgagttctgctgggcgcggtcagtacgctgctgctcaccgagctattcttctgggagttcggcgacagcctgcaggcgctggtgatcggcacggtggtgttcttcaccgcgttcaacctgctggaagcttcgctgccgtcgctgatcagcaaggtttcaccggccggcggcaagggcacggccatgggggtctactccaccagccagttcctcggttcggcgctgggcggcattctcggcggctggttgttccagcatggcggtttgtcggttgtgttcctggggtgtgcaggacttgctgccctgtggttggcctttgctgttaccatgcgcgaaccaccttacgtgacgagcctgcgcttgccgttatcgcccgaagcgatccgcgaagccggtctggtcgagcgcctgaaggccgttgttggggtaacagatgcagtgatggtggccgaagaagccgccatttacatcaaattggacaccgaattattggatcgcgcgaccctcgagcagctggtcaacccagcccgatcggcgtgcgaagcctaggagaacgttatggcccgtggggttaacaaagtcatattggtcggcacttgcggccaggatcctgaagttcgctacctgcctaacggtaacgccgtgaccaacctgagtctggccaccagcgaacaatggaccgacaagcagaccggccagaaggtcgagaagaccgagtggcaccgggtatcgatgttcggcaaggtcgcggaaatcgccggcgagtacctgcgcaaaggttcgcaggtctacatcgaaggcaagctgcagacccgcgagtgggaaaaagacggcatcaagcgttacaccactgaaatcatcgtcgacatgcagggcaccatgcagctgctgggcggccgtcctcagggcgaccagggccagggcatgggcaactccgcgccacgtccgcagcagtcgcgtccgcagccttcgcaggcgccacaacgcgaatcgcgtccagcgcctcagcagtcctcgccacagccggcgcagaacttcgacgacagcttcgatgacgatattccgttctaagagaagcctctcggcaacggcatgaaaaaggcccgtagcgcgcaaacgctacgggccttttgctttctatcgcgaattcagtgttggaaaccttcagttcgtcccagaggctccagcaaagaatgagccgataagaatcagcggctacccgccagaaactcatcggtggacaccacgctggcgtaggcgaatcccagggacgacatgaatgcggcgtggacctgggccgccggcaccaccacaccattgaattcgaggtcgcgggtggcacaggcatcatggatcactgtgacgccatagcccaggtcggcggcagcgcgggtgacgccgtcgatgcacatgtggctcatgctgccgaccaccaccagttgctcgatgccgtgctggtcaagaatggccttgagctcggtttcgcggaacgagttgacgaagtgcttgagcaccaccggctcgtcggcgcggttgctgaccttcggatgcagttgcgcgccgctggagccgggggtgaagaacggcgcgctgtcggaggtgaattcgtggcggatgtgcaccacctgctggccgctgtcacggaaggcctggatcagccgcgcggcattgtcggcggcggcttcgacgccgaccaggggccacttgccgttggggaagtagtcgttctggatatcgactacgatgagcgcttgcttggccatgggtgtttcctctgaagtagtggttggctgtggagtccagtattggctccggcgagccggtcgaggattggccgcaccgacaatagcagggggaaaactgacaatgggtatggaaagcgcagtggccgaattgggcgtgctgatctatcccggcgcacaaatggccgcggtgcatggcttgactgacctgttcgaggtcgccaaccgcattgccgccgaacagcgcagcacacagttgccgctgctgcgcatcagccactggcaggcccaggccgaccaggcccccgtacgggtgtacgacagtcgcccgggtgctgacggtccattgctggcggtgctgatcccaccctcggtggccggtttttcccaggcgcaggtaccgcaggcactgatccagtggctgcgccagcagcatgccaatggcgcgaccctgggcggggtctgtgtcggttcgatcctgctggccgaaagcggcctgctcgacggccgcagcgccaccactcactggacctcggcgaagcggttcgccgagcgctacccgaacatccgcctgaacgccgacaagccgatcgtcgacgacggcgacctgatcaccaccgccggcctgatggcctggtccgagctggggctgcgcctggtcgaccgcctgctgggcccgagcatcgccagcggcaccgcgcgtttcctagtggtcgaacacagcgacagcgccagccagtgcggcagtaacttcgcgccgatcctcggccatggcgacgcggcgatcctcaaggtgcagcactggctgcaggccaatggcgcggtggacgtttcccttgccgtcatggcgcagcaggccgggctggaggagcgcaccttcctgcggcgcttccgggccgctaccgggctcaaacccaccgaatattgccagcacttgcgggtaggcaaggcacgggaaatgctcgagttcaccaacggcaccatcgaccatatcgcctggacggtcggttaccaggacccgggggcgttccgcgccaccttcaaaaagatcacggggcttgcgcccagcgagtatcgcgcgcgtttcggcgtgacaccgccggcaccgctggcgcgggccgggcagggctgaccctgcgggtcgtgcaaaataccgggcgtcgcgggccgatcgtgcaaaataaaacaggcgcaatgccagtagtgatggcctgaagcgcttattccatgggggcattcgacttccccctggccttggcgtgatccctgcaccctgtcttgtacattcatcacgccgatgacgaagggggacgcatgaccccgacgcaacgcaagaaacgggtggtcgcccactcggtccatccgggggcctcgcagcatgtcgtggagaccaatcgcgcgctggcccgctggctggcgcagatcctcgggctggagttcgccggtgactacgacccgctcgtgcatggccaggacgagctgtacctgttgccgacgcagaccatcgtcggccccgccgcggcccggcaattgcggctcaaggggccggacgacctatggggcgggtatgtcgagcatggctttatctgcaccaaggccattacccatggtctgttgaacaggaacgccgtggccccgccgggctgggcgccgctgttctcccagcgggtgcgcaatgtggtgctggacggcctgagcgtgttttccctgaatgacgcccggccagcggccagtcatttgctttacagcgggccgatccgcatgaaaccgatccatgcctgcgccggtcgcggccagcaggtgatcgagaacctggatcgcttcgacgagatgctgacgcaaccggacgttgcccggcagttcaatgaaggcgtggtcctggagcaggatctgcaacaggtggccacctacagcgtcggccagtcctttatcggcggccacgtcctcagttactgcggccagcagtacctgaccgaagactccgacggcgagcaggtctacggcggttccgagctgttggtggtgcagggtggctaccctgagttgctggcgctgcaactgccggaggaagtgcgcctggcggtgcagcaggcgcgggttttcgacgccgccgccgatgaggcttatccacggtttttcgcctcccggcgcaactacgacatcgcccagggcctggacgccgaaggccggcagcgcagcggcgtactcgagcaatcgtggcgcatgggcggtgccagcagcgccgaagtggcggctttgcaagcctttatcgattatccggagatgcgcgcgattcgtgtgtccgcggtggaaacctatgtcgaccggcccttgccgaccgatgccatcgaggtctatcgcgggcccgcggaacacagtgactttcttctcaaatatgtaacggtccaatcctatgacggctagaagcgaaagcattcaaatcgacatcgatgacgagcagatgcgcgggactttcctcagccccaagtcgaaagtccccggcgtactgtttgtccacggctggggtgggagccaggagcgcgacctggagcgcgcccgcggcatcgccgggctgggttgcgtgtgcctgaccttcgacctgcggggccatgccggcagcggcatcccgctgaaccgggtgacccgcgaagacaacctgcgcgacctgttggcggcctatgaccgcctgctggcccatccggccctcgatacctcggcgattgccgtggtgggcaccagttacggtggctacctggcgagcatcctgacctcgctgcgaccggtgcgctggctggcattgcgggtcccggcgctgtatcgcgacgaagcctggaacagccccaagcgcgacctggacaaggccgacctgctggattaccgcagcagcctggtgcgtgccgacagcaaccgggcgctgcatgcctgttcgacgttcaccggggatgtgctgctggtggaatcggaaaacgacgagcatgtgccccatgccacgttcatgagctaccgcgcggcctgccagcagacccattccatgacccaccggatcatcgacggcgccgaccatgccctgagcgatcctgtgtcgcagcaggcctacacctcgatcctggtggactggatcacggaaatggtggtgggagaacgcttgagcatcattcagtcgcgatagtcgcaagtgctggttgaaggcgttgctcgaataggcgcgcaagctcgctcctggagaggagcgcgcgggtttgcgcgatagcctcagttgccttggcgcggttttttctccacgcgcaacgccttggccctggcctccaccaccaggtacatcagcagcgcgatcagcagcggcaggatgaagtagatcgcccggtaggcgatcaacccggccagcaggctgccgcgggacacctcatgttgcagcagggcgataaacaccgcctccaacaccccgagccccgccggaatatgggtgatgaccccggcgatgctgctgatcagcagcaccccgagcaccaccgggtaatcgagcttgctgggcagtagggtaaagatcaccgctgccatcagcgaccagttgagtgcgcccagggccagttgcagcagggccatgtgcaacgagggcaagttgatctcgaccccgtgtatcgaccactcgcgccgtcgggaaaaccgacaggccgccaggtaacccacgcccagcaccagcagcaggacgcccacgccctgcaacgcgccgttgctgagttgccagccgggcggcaacttcatcaggccactggcgaataccgtgccggccaggaccatgtagccgaaccagttggtggccaggctcaggccgaggatcttggcgatattgccggtgctcaccccgagcctggagtacagccggtagcgcatggcgatcccgccgacccaggcgctgaggttgaggttgaaggcgtagctgatgaaccccaccggcaggatctgccgccagccgaggttctgccggatgtaggtgcgaccgatcaggtcgaagcaggcatagaccaggaagctggccagggtcaggcccgcggcgatgaccagggtgcgcaccttgaagtcggccagggtgccgagcacttcgctccagtcgatgcgccgggccagcagggtgaacagcacgatcaacagcaggaagaaggcgatggtcagcggtttcttcaggcgttgccagcgcgaccgggagtgcgatgcggcgggcgtcgagccatgggcgtcagtgcggctcatggggcgactcccgcggggtgacggcctggccgaagggcttcaattgcggcttgtgggcgggtagccagccggcccaggccgggaagtgacgcaggatgtgaaacaccaggaaacccacggtcaggcgccacaagcggccacgcccggagcccttggccggcatggcctggcagtggtcgcgactgagtcggtcgaggcgctcgaacaggtcgcgattgaacgcccggtcgcggatcagcacattggcctccaggttcagcgacaggctcagcgggtcgagattgctcgagcccacggtgctccagtcgtcgtccaccagcgccaccttgccgtgcagtggccgttcgcaatattcgtagatggtcacgccgtccttgagcaggtagtcgtagagcatgcgcgccgccagcctggccaccagcatgtccggctcgccctgcaggatcagccgcacctcgacgccacggcgcgcggcgttgcggatctcgcgcagcagccgatagccggggaagaagtaggcattggcgatcaccacccgctggcgggccccgcgcaatacctggcggtagacctcttcgatatcgctgcggtgctggcggttgtcgcggtagaccaggcgcacctggccgtcatggtcggtcagggccagctccgcgcggcgctgccggcggcgttgccaccagtagcgggcgcgggccgggcggtcgccttgcagcagggcgaaatggtggatatccaccaccgccggcccctggatctctaccgagtaatcctgtttggcctgggggccgaaatcggccaggtggtcggcggagaaattgatcccgccgacaaaggcgatggcgccgtcgaccaccacgatcttgcgatgcaggcggcggaaccagttggtgcgcaccccgaaaatcggctgtgccgggtcgaatatctgcaagcgcaccccggcattactcatggcggcaaggaactcggtgctcaattcgccgcaaccgaagccgtccaggctgacgatgacacgcacgccacgctgtgcggcctcgatcaggatacggtgcagctcgtggccgaccttgtcctcgaagaggatgaaggtctccagcaggatctcgttctgcgcctggcgcagcacttcgaacacccggggaaaatacgcctcgccattctccagcagcaccacccggttgttgctgcgccaaccgtattcgaggtccatccgtagcggctcgtgggccagccccgcgtcaggcgggtggtccaccgtggttttttccaggggcatgtcgttcataactcgacctcgaccgacagcggtgcatgatcggagagatgggaccagggatgggaggccaggacctgggggcggtggattttcaggtgacgcacgtagatccggtccagccgcagcagtggcaggcgtgcggggaagctgcgcgccggtttgccgtgctggctgacaaaggcctcctgcaagccactgggggcgagctgtgcatcggcgcgcagccgccagtcgttgaagtcgccggcgacgatcaagggcgcatcgacgggaagctcggcgatcagctgcagcagcagatccagctgttgctggcgatggctttcgcgcaaccccaggtgcacgcaaatggcatgcacttccagggcatcgccgggcaggcgcagcacgcaatgcagcaggccgcggctctcgtgcccggacagggagatgtcgaggttgtcgtagcgaatgatctggaatttcgagagcagcgcattgccgtggtcgccggccgggtacaccgcgttgcgtccataggcgaactgcggccagatgctgtcggcgaggaattcgtattgcggcatgctcggccaattgttatagcgctgcgggtgctggtcgtgggcgccgtgcacctcctgcaggaacaccacgtcggcggccacgctacgcaccgcctcgcgcagttcgggcaggatgaagcgccggttcagggcggtgaagcccttgtgggtgttcaccgtcagcaccgtgaagcggcgcgcggcggcgagcccgatcgcgggcggtatcgggttgttggccgactcgtcatggctcatggcagcaccccgggcgcggcaggctcgccgggcgccgtcgccagtgtcttgtcgagcccgaagcgctgcagcagccgacgggcgtcgaagggcgcgcggaccttgagatcattgtcgaaataacagaacacctcccggctcttgcgcgccctgggggtgtgccgggcgtcgatcagccgggcatcggcgggttgtttgccgttgtgccaggcctcgatccggtcgccccagcgcttcagggcctggggcgtatagccgctggcgtacagctccttgtcgccatgcagccgcaggtagacgaaatcgccggtcaggtcctcgcaatagggccacttgccggcggtgtcggccaccaccagtgccacgccgtgctggcgcagcagatgggtgaattcgggcacggcaaagcttgcgtggcgaatttccacggcatggcgcatggcttttttgccgtaggccttggtgctggcgtggccgttgaggcgtggttcgtgctggcgggcgagggcggcggcctgttcggtatcggcgggcaattgctgaagaaaggcgccgaacagctcggcgtcgaaccgaaagcttggcgcaaactgccacaggataggtccgagcttgttcttgagctccagcacgcccgaggcgaagaagttggcgatcggcttgtgcacatcccgcagccgcaggatatgggtgatgtagcgtggcgccttgacgctgaacacgaagtccttgggcgtatcggcataccagtcggcataacgctcgggggtctgcagcgcgtagaacgaaccgttgatttcgatgctgttgactgcgcgcgaagcgaattgcagctcgcgcttgtgcgtcagcccctcggggtagaaatctccacgccagggcttgtagcgccagccggaaataccgatatgaatcgccgccatgtccgctcccgtcttggggccttcgaaccacctctgtcttttgatgactgcccggctgacgggaaagtttcgaccttcctacggacggtgttttccagcccgtagccgcgggctggcgggcgatgggtcgcccgacggtggcaaaccctgcgccgggcagtcgctgacgccagccccgccaggcgccaccctttgcgaccgggcataaaaaaacgcagccggccagggctgcgcttttctggttggggcctgctggtgggctcagtgcccgaccaccacccggctcgccccctcggccggctcggcgtataccgggccgaggcgatccaggcggccgctccaggcggtcagggccagggcgcccaataccaccaggccaccgatccaggcggtgtggatcagccccaggtgggcgacgatcaggccgccaccccaggcgccgccggcgatgccgaggttgaaggcggcgatgttcaggcccgaggccacgtctaccgcttgcggggtgtgatgttcggcctggcgcaccacgtagacctgcaggcccggtacgttgccgaaggccacggcgccccacaccagtacggtggccagtgccagccacgggttgccggcggtgaaggtgagcaggaacagcacgccggccagcagggcgaagatgatcttcaaggcgctgatcgggccgcgcttgtccgccagcttgccgccccagatgttgcctacggcgaccgagatcccgtagaccagcagcaccaggctgacggtgctggcgctgaagccggaaatgtcctggagaatcggcgcgaggaaggtgaaggcgatgaacgagccgccgtagcccaccgcggtcatggcgtacaccagcagcaggcgtggttgtttcagcacttgcagttgttgcagcaaggatgccggtttgctgtgggcgatgtttttcggcacgtagatcaggctgccgataaaggcgatcacacccagggcggataccgcgaggaaggtttcgcgccagccgaaatgctggccgataaaggtccccagcggcacgccggtgaccagggccaccgtcaggccggtgaacatgatggcaatcgcgctggcggctttttccttgggcaccaggctggtggcgatggtcgagccgatggagaagaacacgccatgggccaggccggtgacgattcgcgccaggaccagggattcatagctgggcgcttgccaggccagcaggttgccgagggtgaacagcaccatcagcgacagcagcaacagtttgcgcgggaccttgccggtcagcgcggtgagcaccggcgcgccgacggcgacacccagggcgtacaggctgaccagcagcccggcggacggcaggctgacgccgaggtcggcgccgatggtgggtaacaggccaacgatgacgaactcagtcgtcccgatggcgaaggcgctgagggtcagcgcgagcaaggcaatgggcatggctgcaactccggtggatttgacaatggagcgcagtgtccggatttgaatcgtgcggaaaaatagcggttccggtatttgatatttgacctgaaggcaaatatcgagctgagcaatcaacccgcttctgtaggcgcgaagcttgctcgcgataaggctggcgcgatgcaccaggccgcccgcggtccgatatcagtggcgaatcaaccgggtccgcagctcaaggctggcctgcggctcaaggtccagccagacatgcggtttgccggcgatctcggcggctgcaggcaggccgtcgcgatacaccagccggttgccggccaaggccgggaccttcggcccgggtagcaaggtgccggcgaggttcagcgggtcgacgccacacaccgcgatcaggctgccatccagcgggcggcggcgcacttcgcgcaacagggcgatggcctcgggcagggcgaactgctcgccggccaggccgctgacaaaacgcccgccgcgaatttcgccgcgggcctccagccgatggaaggtgcgcaacagttcgcgccagctcggcagccagtcggcctcgcgctccagcaggcgccagaacaccacgccataacgccgcaacagggtcatggcgatgtgttccagggtggccggtggggttgcctgcccatgactgtcgacgccctcaggtactggcgacggacgccgtagcagcgcccagcgccccgcatcgtccataccaccgaccacggctccgcgcccgcgtcggccgctgcgggccagacgcttgctggccggggtgatcaaggcgcgcaggccggcaaaactgtcggcattcacccacccggcggccaccagttcctgcagggcgatctccagctcggtccgcaggacatgggcttcatgctgcaattcatcgaagaacagggcgccgtgctggctcagggcttcatggaccttctgtgccttgggcgacagctcgcggctatcgggctgtgcacccagaccgctccacagcgcgacctggttgcgcggcagcagcacgatcggcgtattgcgcagggtcgcgccggcggttttgtgcggcgcgctgagccggctccagaccaccttgccgttgcggcacagctcatccagccaggtggcggagtaatccttgattcgcgccggcagcaggtcgctgtcccaggcgccggccgcggcggcatagccttcgaactgagcgaccgtctgcgccagcatggcactgccctggccctgggtggcgctggacaggtgctgccagtcgaacagaaaacgcatcaggtcctgcagcgacaccggttcgatttcccggcgcaggcgtttgacggtgtagcgatgaatccgcgccagcagatgccgttcgcaccactcttcccgggcctcgccggggctgaagcggccgcgcagcacataaccttcgccttccagctgcgccaggacctgggtaacctcgctggcgctcaggcccaggggcatggcgatgcgctccagcggcaacgggccgaagccgctgagccgggctcgaatcacttcgaccaccgcttcatcgcgctgccatcgctcatcgaagccgggcggcgcctcgaggaacggttgcagcggcgcctgtggataaatcgcccgcaggcagcccaggcgctcgacggccagccacagggcctgtccgccgccgatctgcaggcggctggcgcgcccgctgtccgccagggcttgcagccagtcggtccacctcgggttggcctgggcttcgtcctcgctgagacaggccaggctcatcagcgcttcatgcatttcgtccgggttgccgggggcgggccaggcttcctcgcgcaccgactggatggcctcggcgtcgagggcgccgaggtcgtcgctggactcggggtcgctccagcggcggctgagcacggcctgggtgcggcgctcttccagcggtgcgtcgtcgaggaaggtgtagggccgggcgctgaggatttccgcggccaggggcgagggcgccggcaggtcgcggctgatcaggcgcagctcgccgcgctcgatgcgccgcaacagagccagccagccctcgctgtccatggcttcgtgcaggcagtcgtcgagggtctgttccaccagcgggtgatcgggaatctgccgttcgccggcgagattctccaggcaggcgatctggtcgggaaacacgctggcgatcaggtcttcgcttttcatccgctggatctgcggcgctaccttgcgcccgccgacaaagcgcggcagcgccagggccacgccggcattccagcgccagcgcacgccgaacagcggcgcctccagcacggcctggaccaggatgtgttcggcgctgttgctgtgcaggtaacgccagacttcctccagctcgaaactgtggccggtggacagcgacagcacgatggcgtcttcgctggcggcggcctgcaattcgaagttgaaggtgcggcagaagcgcttgcgcagcgccaggccccaggcgcggttgatccggctgccgaacggcgtgtggataatcagttgggtgccgccggactcatcgaaaaagcgctccatgatcagcgtgtcctgggacggcagcgcgcccagggcctggcgtgcgcgggccaggtactcgaccagttgttcggcgctggcggcgtccaggcccaggctgtcgcccagccagtcgagggcgggctgtagttggtagggggtggcaccgagcaactcgtcgagccgggccagcaggcgcgccacggcaaacgacagttcggcactgcgcccgggggcttcgccgagccagaacggaatggtcggcggctggccgtgggcgtcctcgacccgcacccggccggtttccacccgcaggatgcggtacgaagtgttgcccagctgaaacacatcgccggcgatgctttccaccgcgaagtcttcgttgacgctgccgatattcagcgcctggggttccagcagcacggcgtagtcggcattgtcggggatggtgccgccgctggtcaccgccgtcagctggctgccccgccggccgcgcaggctacggttgacggcgtcgcgatgcagataggcgctgcggatgccctggcgcccgttgtaaccctcggcgagcatgcgcagcagcgcctggaaatgcccttcgtcgaggtcgctgtagggcgaggcgcgacggatcatgtccagcagcggctgctcctgccattcctggttgctgacttcggcgacgatctgctgcgccagcacatccagcggcgccctggggatctgcagggtgtcgagttcgccgcgatgcacgcagtcgagcagggcggcgcattcgatcaggtcgtcgcggctcagggcgaacaggcggcccttgggcgtgccgccgacctggtgcccggagcgtccaaccctttgcagaaaggccgagatcgaacgcggcgagccgatctggcataccaggtcgacatcgccgatgtcgatgcccagctccagcgaggcggtggcgatcagtacttgcaggtcgccgcgcttgagacgctgttcggcgtccaggcgaaactccttggccagactgccatggtgggcggccaccgcgtccttgcccaggcgctcgctgaggtggcggctcaggcgttcggccaggcgccgggtattgacgaataccagggtggtgcggtgttcccgcgccagttcggcgatacgttcgtagactagttcccagacgtcgttggccatgaccgccgacagcggcacgggcggcacttcgatggccaggtcccgggggcgggcgtggccgatgtcgacgatctcgcaggggcgttcatgacccaccaggaaacgcgacaccgcttcgatgggcttctgcgtggccgacaggccgatgcgcgtcagcggctcggggcatagcgcttgcaggcgctccaggctcaacgccaggtggctgccgcgcttgctggcggcaatggcgtggatctcgtcgacgatcaccgtgcgcgtgctggcgagcatttgccggccggaggccgagcccagcagcacatacagcgattcgggggtggtcaccaggatatgcggcgcgctcttgcgcatggcgctgcggtctttctgcggggtgtcgccggtgcgcaccgcggtgctgatgcgcaattgcggcaggcccatgcgttcgagttgcgcggtgatcccggccagcgggtcctgcaggttgatctggatatcgttgctcaaagccttgagtggcgagacgtagaccaccagggtctgctccggcagcgtgccgccgttttccaggccgcgatgaaccagctcgtcgatcaccgcgaggaaggcggtcagggtcttgcccgagccggtgggcgcggcgatcagcgtcgaacggcgctggcggatcagcggccaggcccgggcctgggcggcggtcgccgccgggaagcagctgtcgaaccaggcgctgaccgcgggatgaaaacccggcagggcgttggcggggatctggggaaggttcatgcacaacgttatgcgaccgccggagtgaagttgcaagcctgccttgtcgccgctggcggcagcggccctgaagggctgtgtgctttgctgctctacactttctcagtgacggttgcgccggaaacccgcaaaatgcaacgattctgagcaatattcatggccagacccgcggggctggccgattcaaaccatcgttccgaacagattgggcctgctgactctatgcgaatgcgccttatgttactgggcggcggaaatgcccttgggcaggcgctgattcgcctcggtgcggaggaagacatcggtttcctcgccccccgtccgccgcaagacggctgggatgccgcgagcctgacgcaactgctcgacgacacccgtccggatgccttgatcaaccttgcgtactacttcgactggttccaggcggagagtgtccccgaggcacgcctggccagccaggaacgagcggtcgagcggctttccgagctgtgccagcatcacaacatcattcttctgcagccttccagctaccgcgtgttcgacggttcgcgggccaccgcctacagcgaaaaggacgaaccggtaccgctgggcctgcgtggccaggccttgtggcggatcgagcagaatgtgcgcgccacctgcccgcagcatgtgctgctgcgtttcggctggctgctggacgatagcgccgaaggcaccctggggcgtttcctggcccgtgccgagcaacccgaagagctgctgctggccgacgaccgccggggcaacccgacgccggtggacgatgccgcccgggtgattatttcggtactcaagcaactcgattgcgccgcgccgctgtggggcacttaccactacgccggccatgaggcgaccacgccgctggcgctgggccaggcgatcctcaccgaggcccgcagcctgcatccgctggccatcgaagcaccgaccgcccaggcccacgccgcccggccggacgctgccgaagaaccgcagcacgcggtgctggcctgcaaaaaaattctgcacactttcgggatcaagccccgcgcctggcgcgcggcactcccggctctactggataggttttatcgtcatggctgatggcccaatcttgatcaccggcggtgccggtttcatcggttcgcacctgaccgacgctttgctcgccaagggctactcggtgcggatcctcgacgatctgtccacgggtaaacccggcaacctaccgctggacaacccgcgggtcgaactgatcgaaggcgacgtcgccgatgcggccctggtggcgcgggccatgagcggctgccgcgcggtggcgcacctggcggcggtcgcttcggtacaggcttcggtggacgacccggtgcgtacccaccagagcaacttcatcggcaccctcaacgtctgcgaagccatgcgccaggctggcgtcaagcgtgtgctgtttgcttccagcgcggcggtttatggcaacaatggcgagggcgaatcgatcgacgaagacacgcccaaggcaccactggacgcccgtatgcgtcggacaagctggccagcgagtactacttcgatttctatcgccgccagcatgggctggagccggcgatcttccgcttcttcaacatcttcgggccgcgccaggatccatcctcgccgtactccggggtcatcagcatcttttgcgagcgcgcgcagaaaggcctgccgatcaccgtattcggcgatggcgagcaaactcgcgatttcatgtatgtcgaagacctggtggacgtgctggtgcagtccctggaaacaccgcaactggaagtcggcgcggtcaatgtcggcctgaaccaggccaccaccctcaagcaattgctcgaggtcctgggcgaggtggtagggcagttgccaccgatcagctacggcccggcgcgctctggggacattcgccattcgcgggcgaacaaccagcgcctgttgcagcgcttcaaactccccgaaccgacgccgatgagcgtcgggctggcacgtttgctgggccgctgagctttccccagcgatgaaaaaaggcgcctttgcaggcgcctttttttgtctggccgatttagaacttgtagcccaggccgaccatgtagacccatggatcgacatccacgtcgaccttggcccgggtgccgccggcgaccgcgttgttgttcacgtaggcggtggtgtcgatgtcgacgtagcgcacctgggcgttgatcatcacgttgtcggtcagcatgtagtcggcaccgacctgccaggccaggccccaggagttcttcgcccggaaattgtcgaaaccggcggcgctggcacggctgccgacgtgttcgtcatagatccaggtgtagttgataccggcacccacgtaaggctggaaggcggccttgtggtccagtgggtagtacacgacgctcagggtcggcggcaggtgcttgagggtaccgagcttgccgttggcggcgtccagcgcggtgcccttgagcttgacgtcatgctcgaacggggtggccgcgagcagttcgataccgacgttgttggtcagcatgtaggcgaagttcaggcccagctgggtgtcgctgctcatggtcgccttgccgccgaggttggcaccggccaatggaccgcggtcgaccttgacgtcgccgctgtcggctttcggattgacggtgatggcaccggcgcgaacgatgatgtcgccggcttcgtgggcgtgggcgatcggggcggcgagcgcgagcgcgaacagggaggcgctgagcaggggcttgtgcatgggagctccaaaggacgattcgagttggctaggtccaatggtaaggatcgtcaaggaacaggctttgactcagctcaatgaaaagcggatcagcgtgggagcgaggggggtagggggctctaggcgctttggaatcgatcgcgagcaagctcgctcctacatgaacagtgcggttacctgtaggagcgagcttgctcgcgatgaggttatgtgcggcactgcaaaaccggcggtttcactcctgcaattcgtacacgtaaatcttctctgcctccatctggtaacccgcgtcggcgatttcgctggtggatgccttgacctgcatcggcccctcgatccagtacggctgatacagctcgtcgagcttcacgccgacttggcttttcacatgcacgatctggttcgacggcggtggcggcacgtggatgcaggcgccgaaatacggcaccagcagaaactccgtggtgcggccttcctcgctgacttccagcggcacgatgtagccgggcaggcgcaccgacaggccgtccaggctctgcaccaccggagcgttgggcatgtcctgcttggccgccggggcggactcggcggccagggcgtcgctcatctgcgacaggtcgtgcagcggctgcatgttcggcacctccgccggcgcgtccggcgggatcatttccgaccaggccaggtcacggggttcggcggcccacagtggcagggcgaccagcatcaatagcgcaagcagggcacggggcatgccggagctcctcataaccggaagttcctcataaacggatggacaggccatcggccagcgattgtcggtaggcgcgccaggcgggcacgctgcccatcagcagggcggcgatcaggataccgccgagcagcgtccactcatactcgcttggccaggacagcggcaggttcaggccgtagctcgactgcacataaccctgggccagggcgatgcccaggtacagcaggcccagcccggcgagcacaccggacagcgccagggcgaaggcctccagcaccagcaaggtcgcgatatgccaggggcgggcgccgaccgaacgcaggatcgccatttcccggcggcgctcattgaggctggtgaggatcgccgtgagcatgccgatcaggccggtcagcaccacgaacagcgacaccacgaacaaggccttttccgcggtgcccatcaggctccacagctcctgcagggcgaccccgggcaagatcgccagcatcggttcgccgcggtattcgttgatctcgcgctgcaccgcgaaggtggcgatcttgctgttcaggccgagcatgaaggcagtgatcgcttgcggcgtcaggtccatgttgcgcgcctggtcggcactgatgcggccgttgccctgggccggcacgccgttgtgccagtcgatatggatcgcctccatgccaccgaggctgatgtgcagcgtgcggtccaccggggtgccggtgcgcttgaggatgccgaccacggtgaagggtttgtcgtcgtgcttgaccaggctgatggccgctacgccgtgggccagcaccagcttgtcgccgagcttgtaatgcagggcctcggcgacttcggcgcccagcaccacttcgaacggatcgctggcgaactcgcggccgctggccagttgcaggttctgctggtggccgtactggtaatgctcgaagtaggccgcagtggtgcccatcacccggtagccgcgatgggaatcgccgagggaaatcgggatcgcccatttcactttcgggctattggcgaagtgctcgaagctgtcccagcgaatgttgttggtggcgttgccgatgcggaacaccgagtacagcagcaggttcaccgaaccggagcgggcgccgacgatcaggtcggtaccgctgatggtgctggcgaagctggcgcgggcttcggtgcgcacccgttccaccgccagcagcaggcagaccgacagggcgatggcgaaggcagtgaggatcgcggtgaagcggcggttagccaggctggccatggctagacggaacagatacatctcagacctccgcgggcgtggcggcgcgattgagctcggccagcgacaggttgcgatcgaacagcggcgccaggctctggtcatggctgacgaacagcagactggccccggcctcgcggcattcggcgaacaacaggcgaataaaggcttcgcgggcgtcgtagtccagtgccgaggtgggttcgtcggcgatcaccagttccggttggccgatcagcgcgcgggcggcggcgacccgttgttgctggccgatggacagcgagtcggcgcggcgaccgagcaggtcggggtctttaagccccaggtgggcgagcagggtggccgccgcctggtcgacactgccgtggcgctgtacggcgcggctggcgcgcaatttggagaagtggcagggcaactcgacgttttcgcgtaccgagagaaacggcagcaggttgaactgctggaagatgtagccggtgtgatcgacccggaagcggtcgcgggcgccggcggagagttcggtcaactcctggcccagcaggcggatgctgccgcggccgggtttctgcacgccgccgagcaggccgagcagggtggtcttgccgctgccgctggggcccttgaggaacagcgtttcacccgcttccaggcgaaaggccgggatatccagcaactgcggatggccgggccagctgaagcccaggtcggacagttcgataagtgcttgggtcatgttgggccgatcatggagtgagttttgtagccgctgccgaaggctgcgataaggtccgcaggaccttgcgaaaacctcaagagcaacgaccccttcgggctcgatcgcagcctgcggcagcggctacaggagttgcgtcagaatttcaggctggcggccttggaggtcgcttccacgccttgctggccacttggcgagatgagttgtacctgaattttctgggtggcggggaaggtcttgaacacgccggccaggtccaggttcttcagcgcgcccggcgtggcacaggtgaactggtagtgcgcatggatctcgctgtgttcgtggtgatgttcgtggccgccggcactcttcgcgtcgtcatggtcttcgtcgtgatcttcgggcttgtcgccgaacagcgggctttccagttcctgttgtgccaccacgcaaccggcggcgggcggcaggctgaacagcgccagcggtttttccagctgcgcgcgcacggcggcgaccttggccttgtccgcgtcggtgctggcggcgtgctcgaagcccaccaggttcatcgccgggctttccagttccagctccagggtctggccgtccagtgccgcgttcaggcgggccacgccatgctcgtgagcaccgaggctgccgtgctcatggtcgtggtcgtgtttttcggccgcgtgagcgatggccaggggcaacagggcgaacggcagggcgagcagcagacgacgcatggcaagtctccgggagcgaacatgaaaataatgttatgtaatcttataacggaagtggcgagagtttgaccgcctgcttggcgttgcgcaagacgcatgggagcatgctcgtcagaaaaattcgggagcagagcgatggtgcggattcgtggaagcatcggcgaatggccggtggatttgaccctggaactggatgaggccgactgggatcagttgagtgcccggctggggacgccgttgcaggcggccaaagccgaaagcggcgggcctgtggccgagccggcgagccaggatgatgcgttgtggcagatcacccaggacctgctgcgcaaggccgggcaattgagcggcccggatcttttggagcaactggaaggcctgaccggcagcgccgcggcgggcaagcggctgttggtgcgtttgcgccatagcgcacaggtcaaggtggtgagcggcggtgatacgccgttctacagctgggtcgagtagacgagggctgcgccggcttgcgataaaccggcgcggctatcagctatgaatcagtacagcgcggcgaacagcttgcgacggtaggtggtcaccagcgggtgatcgttgcccagcagctcgaacacttgcagcaaggtcttgtgcggcaggccttcgttgtagctgcggttgcggatgaacaacttgagcagggcatccagcgccgcgtcgtactgctggcgtgccagctgctggatggccagctgatacaccgcctcgtcatcctgcgggtcctgcgccaggcggcttttcagctcggcgctgtctggcaggtcggcggcctgcttgaggaaggtaatctgtgccttggccccggccagcgccgccttgtgttcatcgccggtgaccgcgtcgagtacggtctgggcttcgcccagttcgccgcgttcggccaggcagcgggcgtagaggatcaaggccttggcgttgctgttgtcttcgcccagcagcactttcagcgtggcttcggcatcggcgatgcgcccttcggcgaacagcgcttcagccagctccagcgggtcggcggccttgggcggcggcatctgcacatggggttcgagcatggtgcgcaccgcggactccggttgcgctccggcaaagccgtccaccggctggccgtccttgaacagcaccacggtcggcaggctgcgaatgccgaagcgggcgacgatgtcctgctcgatatcgcagttgaccttggccagcagcagttcgccctgatagctctcggcgatctgttgcagcatcggcatcagcgccttgcagggcgcgcaccattcggcccagaaatccaccagcaccggcttgtggaacgagttctcgatcaccgactggtcgaagtcggcggtgctggcgtcgaaaatgtacggcgtgtcctgactcatgggggatctcgaagaacgtgaatgggccaactataagggctggcggggtgtgcctgaaagcggtggctgtccgttcgccggttatcgcgtagcgctggcaggggctcaatcgcgctgcgcgtgatacaggctcacttcgcggaactcccagggctcggccagatccggcaggttcagggcgtggagcatttccaggcgtcggtacagcggatgctggaagtccttgacccgggagtccgccaccagcgcctggcgtccgcggctgaggaactcatccagcagaggcaggttggcgcggtcgtagagcacgtcggccaccaggatcaggtcgaagcgatccgcttgcgcgaaaaagtccgtggagtaacccagttcaaccccgttgagcgccgcattcgccttgcaggcggcgatggccagcgggtcgaggtcgcaggccaccacttccagcgcgccggctttcagcgccgcgataccggccacgccggagccggcgccgaaatccaggacccgcttgccttgcacccactgcggacgctcggccagatagcgcgccagggccaggccgctggcccagcagaaactccagtacggcggttcgtggagaattcgccgggtttcttccggggtgaaggcgcggtccatgttgtcggcatcgatcaaccacagcttcagctcggtgtccggcagttcgcaggccaccagttgggcatcgcccagcagttcgctcagggcgcgttgcaggtcgagcggtggggtcatggtgctttgacgaattgcagctggcccacggcctgggtggtcggctgggtgatgagttgcgccggcaggtgcaggatcaactggccggactggctggcgcggccgcgcagttcaacgcgggtgcctaccgggaagacatcgggattgaagcgcaggcgaaacggcaggaccttgttgttgccgatcaggttgctgctggccagcaaacgttgcggccggccgcgctcgtcgatcaccagcagcgccagttccacctcggcaccgctcggtacgccctgcagggtgccgctcagttcacgctggtaggccggcagggggccgaggtcagtggattcctgggcttttttcacactctgctggggcggcacggtggaggtggccggtttcggggcgtcgctgctgcaagcgaccagcaggctgaaaaggctgagcaaaacgagcggtcgtagtggcatgcgaagctccaacaaggcgaaattccatgtgcaaaacataatagtcggtctgtataccgtaaaggctatggcttgtcttgccagtgggatgcgctaccatggccctccctttttttgttgcctgccaccatgcactgtcccttctgcggtgccaacgacaccaaggtcatcgactcgcgtctggtcgccgaaggcgaacaggtgcgccgccggcgtgaatgcctggcctgcggtgaacgtttcaccactttcgaaaccgccgaactggtgttgccgcgcctgatcaagactgacggcagccgccagcccttcgacgaagaaaaactccgcgctggcatgcagcgtgccctggaaaaacgtccggtcagcgtcgagcgcctggaagccgcgctggtgcatatcaagcacaagttgcgcgccactggtgagcgcgaggtcaaatccctggtcgtcggcgaactggtgatggccgagctgcaaaagctcgatgaagtggcctatatccgcttcgcttcggtctaccgacggttccaggatctcaacgaattccgcgaagagatcgaccgtctcgcccgcgagccgggcaaagaatgaacacctccagcgaacaggcggtgctcgacgcccactatatggcgcgcgccctggagctggccgcaaaaggtcgcttcagcactcatcccaacccccgggtcggttgcgtgatcgtgcgcgacggccaggtcgtcggcgaaggctggcatgtgcgggccggcgagccccacgccgaagtccacgccctgcgtgccgccggtgccaacgcccgcggcgccaccgcttacgtgaccctcgaaccctgcagccatcacggccgtacgccgccgtgcgccgatgccctggtggatgccggcgtggcgcgggtcgtggcggcgatgcaggaccccaacccggaagtcgccggccgtggcctgcagcgcctggcccaggccggcatcgctacccacagcggggtgatggagcagcaagcccgtgccctcaaccagggtttcctcaaacgcatggaacagggcttgccgttcgtgcgggtcaagctggccatgagcctggacgggcgcaccgccatggccagtggcgaaagccagtggatcaccggcccagccgcgcgttccgcggtgcagcgcctgcgggcccaggccagcgtggtgttgaccggtgccgacacggtgctggcggacaatgcccggctgacggtacgtgccgaggagctgggactggacgcggaacagaccgccctggccatgagccgtccacccttgcgcgtgttgatcgacggccgcctgcgggtgccgctcgatgcgccgttcttcaaggcggggccggcgctggtcgccacctgcgccgcggtggaggaacagtacgccaatggtccggagtgcctgatcgtgccgggcgccgatggccaggtggacctgcgtcggctgctgggcgagctggctgcccgcggcgtcaacgaggtgctggtggaagccggtccgcgcctggcgggggcgttcgcccagcaaggtttggtggacgagtatcagatctttgtcgccggcaagttcctcggctctacggcccggccgctgctcgactggccgctggcgcagatgagtgaggcgccgcagctgaaaatcattgaaatgcgcgccgtaggcgatgactggcgagtcattgccattcctctgccagcagcgagcgtataatttcgggccttcgccacgcggcgaccctgttctcgaggaggactccatgtttacaggcatcatcgaatccatcggcagcatccgtgcattgactcccaagggcggcgatgtgcgggtgtatgtggaaaccggcaagctcgacctgggcgacgtgaagctgggcgacagcatcgcggtgaacggcgtctgcctgaccgcggtggaactgccgggcgacggcttctgggccgacgtcagccgcgagaccctggattgcactgctttccatcaattgaaggccggcagccaggtcaacctggaaaaggccctgaccccgactacccgcctgggcggtcacctggtcagcggtcacgtcgacggcgttggcgaagtggtggcccgggaagaaaatgcccgcgccatccagttccgtattcgcgcacccaaggacctggccaagtacatcgcccacaagggttcgatcaccgtcgacggcaccagcctgacggtcaacgcggtcaatggcgccgagttcgagctgaccatcgtcccgcacacgctggccgaaaccatcatggccgactaccggccgggtcggcaggtcaacctcgaagtcgacctgctggcgcgttacctggagcgcctgctgctgggcgacaaggccgcggagccttcgagcggtggcatcaccgaaagttttctggccgctaacggctacctcaaatcctgaacctcaaattttgaaagaagggggtgccgcgtggcgctcaacagcatcgaagaactggttgaagacatccgccaaggcaagatggtgatcctcatggatgacgaagaccgcgagaacgaaggcgacctgatcatggccgccgagtgctgcaaggccgaacacatcaacttcatggccaagcacgcccgcggcctgatctgcatgccgatgagccgcgagcgttgcgagctgctcaagctgcctttgatggcgccgcgcaacggttccgggttcggcaccaagttcaccgtttccatcgaggccaccaccggcgtgaccaccggcatctccgccgccgaccgcgcacgcacggtgcaggcggctgccgccaaggacgccaaggccgaagacatcgtcagcccgccacatcttcccgctgatggcccagccgggcggcaccctggcccgcgccggccacaccgaagccgcctgcgacctggcgcgcatggccggtttcgagccgagcggggtgatctgcgaagtgatgaacgacgacggcaccatgtcccgtcgcgccgaactggaagccttcgccgccgaacacaacatcaagatcggcaccatcgccgacctgattcactaccggatgatccacgaacgtaccgttcagcggattgccgagcagccgctggacagcgaattgggccagttcaacctggtgacctaccgtgattcggtggaaggcgacgtgcacatggcgctgaccctgggcaacatctgcgccgaagagccgaccctggttcgcgtgcacaacatggacccgctgcgcgacctgctgatggtcaagcagcctggccgctggagcctgcgggccgccatggccacggtggccgaggccggcagcggcgtggtgctgttgctgggccacccgctggacggcgacgtgctgctggcgcatatccgcgaaacggccgagcacgtgcctgcgaaaaaaccgaccacctacagcatcgtcggtgccggttcgcagatcctgcgcgacctgggcgtacgcaaaatgcgcctgatgagcgcgccgatgaaatttaatgcgatatccggtttcgacctggaagttgtagaatacgtgccctccgaataaaagccggttgtttcgggcttgaaattcgcggttcaaatatcactagtgagcgcgtagtgaacgcgctccggctctttaagagatttgtcgaatgaccctgaagaccatcgaaggtaccttcatcgcccccaaaggccgctatgccctggtggtcggccgtttcaacagcttcgtcgtcgaaagcctggtcagcggcgccgttgacgccctggtccgtcacggcgtgagcgaaagcgacatcaccgtgattcgtgcccctggcgccttcgagattccgctggttgcgcagaaagtcgcgcagaagggcgagttcgcggcgatcatcgccctgggcgcggtcattcgtggcggcactccacacttcgaatacgtggcgggcgaatgcaccaagggcctggcccaggtgtccatggagttcggcgtaccggtcgccttcggcgtgctgaccgtcgactcgatcgagcaagccatcgaacgttccggcaccaaggccggcaacaaaggtgctgaagctgccttgtccgctctggaaatggtcagcctgctggcgcagttggaggccaagtgattagcgacgatagcgatcgtttcaacccgcgcgatccgaaacctgcggacgctggcaagccatccaagagcgccaagcgtcgcgaagcccgtcagctcgcgacccaggcgctgtaccaatggcacatggccaagcactcgctgaacgagatcgaagcgcagttccgggtcgacaacgatttcaccgacatcgacggtgcctacttccgtgagatcctgcacggcgttccggccaacaagaatgagatcgacaacgctctcaccccttgcctggacctcaccatcgaagagctggacccggtcgaactggcggttttgcgcctctccacctgggaactgctcaagcgcgtcgatgtgccgtaccgcgttgtgatcaacgaaggtatcgaactggccaaggtcttcggttccaccgacggccacaagttcgtcaacggcgtactcgacaagctggccccgcgtctgcgtgaagctgaagtgaaggcattcaagcgctgatccgcgcttgcagctgccatgggcgagtttgagctgatccgtaacttcttcgctgccgcgccttgtgcgcagggcggcgagggcgttgcactggggattggcgacgactgcgccttgctggctgttccccctggcgaacagttggcgatctccaccgacaccctggtggccggtgtgcatttcgcagatccctgcgaccctttcctgctcggccagcgctcgctggcggtggcggtcagcgacctggcggccatgggcgccgcgcctgtcgccttcacccttgccctgactctgccgacggttgacgccgattggctgcaagcctatgccaacggcctgagcgccatggcgcagagctgcggcgtgcgcctggtaggcggcgacaccacgtgcggcccgttgaccctgaccctgaccgtgttcggtcgcgtgcccgccggccaggcgctgacccgcagcggtgcccgtccgggcgacctgctgtgtgtcggcggcgagctgggcaatggcgccggtgccttgcccctggtgctcggacaacgcagcgccgagccgacggttgccgagcctttgctggcccattactggtcgccgcaaccgcaactggccctgggccaggcgctgcgcggcaaggctagcgcggccatggatatctccgatggcctgctggccgactgcgggcacattgctgccgcttcagctgtcggcttgctgatcgaaagtgaaaaactgccgatgtcccgggcgttgttgagctttctcggtgagaatggcgcccgctcggcggcactcagcggcggtgacgattacgtgctggtcttcaccttgcccgaagccgagctggcgccgctgctcgccgccggctggccggtgcatatgctgggccgggtcgtggccgggcagggcgtggtgctgctggatgccgaggggcgggacatcaccccgagcactcggggctatcaacatttttcgggagacaccgtgacagatcatcccaaacaggttccggcagagttcgtgccgccctccgtctggcgtaatccctggcattttctggccttcggcttcggttcgggcaccttgcccaaggctccgggtacctggggctcgctggtggcgctaccctttattccgttgtggcagatgctgccggactggggttactggctgatgctcggcatcaccatgctgttcggcttctggctgtgcggcaaggtggccgacgatctgcgggtgcatgaccacgaaggcatcgtctgggacgaaatggtcggcatgtggatcaccctgtggctggtgccggaaggctggcagtggttgctggcgggtttcctgatgttccgcttcttcgacattctcaaaccctggccgattcgctggatcgaccggcatgtgcacggcggtatcgggatcatgctcgacgacgtgctggccggtgtcttcgcctggttggccatgcaggggctggtgtggtgctttacctgaggagtcagccatgccggccgttcgcgttctgctggtaatgctctgtgtcttgaccgccagcttggtccgggccgccgagccggcggcgcttcccggcgaaatccgggtggccagcgaggagtgggacagctacacccaggccgatggccagggcatggcctgggatatcctgcgcgagatcttcgagacccagggcgtgaagctcgacatgcgcagcgtgccgtacacccgctcggtcgggttggtgcagcggcgtgaagttgatgccctggtcgggtcctatcgggacgaaaccgatggtgccctgtatccacgctggaactacgacaccgaccatatctacagcctgggcctggcgacgaacccgccgccgaccctggccacgctcggcaactaccgcctggtctgggtacgcggctaccgctaccaggactacttgcccaatattcagcgtttcaatgaaatccgccggcgtgtcggtatcttgccgatgctccagcaaggtcgtgccgacttctatatcgatgccctgaccgaggtcgatattgtcctgtcccaggccggggaccgctcgcagttccggcgcagccatttggccgaactgccgctgtacctgggctttgccgacaatgaacggggccgggtgctgcgcgcgctgttcgatcggcggatggccgagttggtgaaaaacggccgtttgcgcccgattttccagcgctggcagcagccctatccgttcgataccgggcgtccgcctgaagaccgttgatctaacttctcgatctttatgtccgataattcagcctaagcgtctgtcggaagctgctgttacaatgccgcctctgcgaatctccagtcccatacagatcaggagcacaacggtgcccgtcgtttttgtcgccgcttccaagctgcccaccccttttgcgcaattcaccatgcacggttttctcgatgaagccaccggccgcgagcacgtcgtgctcagcctgggtgatattgccgatggcgctccggtgctcggccggttgcactccgaatgcctgaccggcgatgccctgttcagccagcgctgcgactgcggttcgcaactggaagccgccctgcaggcgatcgcccgcgaaggccgtggcgtactcctgtacctgcgtcaggaaggccgtggcattggcctgctgaacaagatccgcgcctatgagttgcaggatggcggcgccgacaccgtggaagccaacgaacgcctgggctttgccgccgaccagcgtgactacgccatgtgcctgccgatgctcgagcacctgggggtgaaatccctgcgcctgatgaccaacaacccgcgcaaggtcaaggccctgaccgagatgggtatagtggtcgccgagcgcgtgccgttgcataccgggcacaacccgcacaacaaactctacctggccaccaaggccagcaagctcgaccacatgatgggcaacgagcaccagggcgaggtagaccgggcgtgacccgcggtcaggtccggcggcgcctggccgtcagttggtggcaatacctggcgctggcgctgctgccgctgttcgtgatcaacctggtgtttggccagggcgagccgctgctgccgatcctggcgatgccgtttttcatcgctggcgtagcttcgatgtttgtcagcctgcgttttttcggcggctacaaacgggccttgatcgccacccataaagccctcgatacccccgaagagccagcggcctggatcgagctggcggcccgccgtcgcgcggcgtttctggccgcggccctgccggcctgggtcggcgccctggcggtgttcgtcggcctggaagcggtgccgctgatcctgctggcgctgtccaccgcggtgctgttctacctctaccgcatcccgcgtcagctcggttgatgcgccgctggctggcagtcctgctgctggccctcgcaggcccggcgctggccgtggagcgggtggtcagccttgcgccttcgctatcggaaatcgtcgtcgaactggattccgccgacctgctggtcggtgtgctcgacgccggcgagcgtccctctcaattgcacaacctgccgtcggtgggccgctacggccagttggacatggagcggctgctcagcctcaggccggatctgctcctgctctggcccggcagcgttggcccggcccagcgcgagcagctcagccgcctgggcatcccgaccctggtggccgaaccccatagcctcgaccagctcaccactcaaattgaaaccgttgccgcccggctagggcgcccacaacgcggcctggagcgtgccaatgagttgcggcagcaactggccggcctgcgccaacgctatgcccgcagcgcgcccctggcagtgttctatcaggtctgggaccagccgctgtacaccgtgggcggcgggcaaatcatcagtgatgccttgagtgtgtgcggcgcgcgcaatgtgtttgccgacctgccgctgccagcgccccaggtcagcgtcgaggcagtattgcagcgcaatcccgaggtgatcctggccagcacccaggcgcaacttgacgcctggaaagcctggccgcaactgaaggcggtggcgcaaggccggttgttgctgatcagcgataaaggcctggaacggccgagcgggcagatgatcgccgcgacggccaagctctgtgagttgcttgattccgagtagcggctactggcgtatcgcgagcaagctcgcccctacagaaaagccgggagcagccggtcgacgctcgattgctcgcgatagcgtcctcacaggcgccactaaagctccggcgtccaggtcaccccgaacatccaggcccggccttgctcccgatacccgtattgcgcgccgtcatggctgtacagcacccggctgtaggacttgtcgagcagattgtcgaccttcaactccaaccgcacctcgcgagtcagcgcccagctgctgcgcaagcccagcagggcataaccgccgaggcgttgctggttggccaggtcgtcatagctgctgctcactacttgccagctggcgccgaggcccaggcggtcgaactgccgatccaggtccaggttcagggtgcgccgggcacggcgggccagggtgtggccggtgtcgcggtcgcggggatcgatgatcgccagccccagattgctctgccagccgaacaactcctgctgcagcgtcgcctcgaagccgttgatgcgtgccgaggcgacgttctgcgggcgcgaattgctgccgaagataatcgcgtcttccaggtcggtgcggtacagcgaggtttccaggcgagtggtttcgttcagctggctgcgccattgcagctcgtagcttttcgaggtctcgggcttgaggtcggggttgctgaagtcggggtaatacaggtcgttgaaggtcggggcgcggaagccttcgctgtaggtcagcaggacatcgttgtcggtgttcagcggcagggtgagggtgccgctccagctgttctggccgccgaattgctggttctggtcgcgacgcaggcccagttcggtggagaaactgtcggccttgaagcggtgctggacaaaggccgcgcggttccagcggctgtcctcggcgaaggcggtgctgctgttgacccggtcttggtaccagtcgccgccgacgatcaggctgttgcgttcgtcgagggtcaggtcgttctgccagttgaccgagtcgcggtaggtgttgaacaccgtgcgttcgtcgctgcgcttgtcgaaggtcttctcgcggttctcgctgtgacccagttccaggcgcgacttccaggcttcgttgatgtggccgtcgacatagctgccgaagctgctgaccgcgaattcgctgtagggcttctgcgggaagctctcgaaggtgctgctgtcaaagcgcccgaaggggttgtcgaactcgcttttgccgcggttatccagcaggttcaggcccgcctcccagtcgtcattgaacgcatggctcagactcaggctgagggactggttgcggtaggcgtcatcatcgcgatcgctggcataggactcatgggtgcgattgctcccggccgtgtcgtcgaggctggcgcccaggctgaagcgggtctgctggtcgacgccggacaggccgatgctgcgctcccaggtctggtggctgccgacccccaggtgcaggcggggttgcaggccctgctcggcgctgcgccgggtgaagatctggatcaccccgccgatggcgtcgctgccgtagatcaccgagcgggagccgcgcagcacttccacccgctcgatctgctggatattcagatgctgcagattgctgtcgccggagctcgaactgccgatgcgctggccatccaccagcaccagggtctgcgccgacgaagtgccgcggatatagatccccggcacgctgccccggccgccactctgcgccacttgcacgccaggcacccgttgcagcaggtcggtaacgctggagggttgcaggcggtcgatgtcgtcgcgggtgaatacggtgttggcggcgctgctgtcgttgcgcgcctctacctggcggttggcgctgatcagcgtgtcgggcagcttgagggcctgttcgcgctcgagagtgtcggccagcagttggccggtgggcagcaggacaaggggcaggacgaggagggcgggtttcatcggcaatctatagcgaatggagcatgcgaggaaaaaccgtagccgctgccgcaggctgcgataaggtccgcaggaccttcctgcgacctcaaaagcaacgcccccttcgggggcgatcgcagccttcggcagcggctacaggttacaggccgagccgttgcaggcgtgcccgtatggcggcttcgataccggcttcgtccaggccgcattcggccagcatctgcgccggtttggcgtgttcgacgtagaggtccggcaggcccaggtgcaggatcggcttgaggatcgcctcgcgcgccaggaattcgccgaccgcgccaccggcgccgcccatgatggcgttctcttcgatagtcaccagcagttcgtggctggcggcgatctcgcacaccagggcttcatccagcggtttgacgaaacgcatgtcgaccacagtggcatccagcttgtcggcgactttcagtgcctcggccagttgcacgccgaacaccagcaaggcgaccttgctgccctggcgacggaccacgcccttgccgatctcgatcggctgcaggtctttctcgatggtggcgttcgggccggtaccgcgtggataacgcacggcggccgggccgttgtacaggtggccggtgctgagcatcttgcgcagctcgttctcgtcgctcggggtcatcaccagcatgccggggatgcagcgcaggaacgacaggtcgaagctgccggcgtgggtcgggccgtcttcgcccaccaggccggcacggtcgatggcgaacagcacgtcgaggttctgcaccgctacgtcatgcaccagctggtcgtaaccgcgctgcaggaaggtcgaatagatcgccaccaccggcttggcgccttcgcaggccatgccggccgccagggtcacggcgtgctgctcggcaatcgccacgtcgaagtagcgcagcgggaagcgctcgctgaaggccaccaggtccgagccttccttcatcgccggggtaatgcccaccaggcgcgggtcggcggcggccatgtcgcacagccattcgccgaatactccggagtacttcggcccgccggcctttttcggcgcggcagcggggctgtccagagggtcgagcttggtgatggcgtggtagccgatcgggtcgacttccgctggggcgaaacctttgccctttttggtcaccacgtgcaggaactgcggacccttgaggtcgcgcatgttgcgcagggtggcgatcagggtcggcaggtcgtggccgtcgatcgggccgatgtagttccagcccagttcttcgaacagggtgccgggaaccagcatgccttttgcgtattcttcggtgcggcgggcgatttcccaggcgccgggcaggcgcgacagcaccttcttgctgccttcgcgcatgctggcgtaggtgcggctggaaagaatcttggccaggtaattggacaggccgccgacgttgcgcgagattgacatgtcgttgtcgttgaggatcaccagcatgttggcgtccacttccggcgcgtggttcagcgcctcgaaggccatgcccgcggtcagggcgccgtcgccgatcaccgcgatcgccttgcgctcgctgttctgcaggcgggcggcaatggccatgcccagcgccgcgctgatcgaagtgctggagtggccgacgccaaaggtgtcgtactcgctctcggagcgccgcgggaaggcggccaggccgtccttctggcgcaggctggccatgcgctcgcggcgaccggtgaggattttgtgcggataagcctgatgacccacgtcccacaccaggcggtcgtccggcgtgtcgaagacgtaatgcagcgcgatggtcagctcgatgacgcccaggccggcaccgaaatgcccaccggtctggccgaccgtatagagcaattccaggcgcaactcatcggccagggtttccagctcggcttcgcctaaccggcgcaggccgtccggcgtgttggcacggtcgagcaggggcgtggtcgggcgcttgcggggaatctcatgaaacgtcgtgggcatcaggcgaatcgttataggtatagaaagaggcggcagtttaccttatgcatcgcaagctgcccacgcagagcgcggaacttggccgatatgcggtctgccgcgccggggtcgatcaactgcgtcgttcgacgatataacgcgccagctcccgcagaggctcggcgcccgcgtcaaagggtcgcagtgcgtgcagggcctgatcgcgcagttccagggcataggctttggccgcttccaggccgagcagggccgggtaggtcggtttgtcccgggcgatgtcggcaccctggcgtttgccgagggtcgcggtatcgctttccacgtcgagaatatcgtcctgcacctggaacgccaggccgatggcctgggcgtaggtctgcagggacttgagctcgtctttttcggcccggccgctggccagggcgccgagcttgacgctggcctcgatcagcgcgccggtcttgtgccggtgcatgtactccagggctttctggtcgagcttgaggcccaccgaaccgaggtcgatggcctggccgccgaccatgcctgcggggcccgcggccagcgccagggcgctgaccatctgcaggcggatctcggcactcgaatcgctcaggcgcgggtcgagcagggcgctgaaggccaggctctgcagaccgtcgccggcgagaatcgcgcaggcttcatcgaaggctttatgggtggttggctggccgcgacgcaggtcgtcgtcgtccatcgccggtagatcgtcgtgcaccagggaataggcgtggatcagctccaccgcgcaggccgcgccgttggcctgttccggccgggcaccgagggcttcgcaggcggcgtaggccagcagcgggcgcacgcgcttgccgccgttcatcacgctgtagcgcatggcctggtaaagacgggccagctccgggcttggcgcgtggaacagggtttccagtgcagcattgacccgggcctgactgctggcctgataggccgcgatcattctggctgttccgcgtcgaagggttcttcggccagttcgccatcgcgctccagcaggatctgcaccttctgctcggcctgggccagcgccgcctggcaatcgcgggtcaggccgatgccttgctcgaaggcggtcaacgagtcttccagcgacagctcgccgttctccagacgctcgaccagcgtttgcaggtcggcgagggattgttcgaaatctaaggcagcttttttgcgggccatggcggctatcccggttgacgttaaaccggcgcgacactagcagacatggggggttggggcaaatgaggggggggatcggaggctctctctgggtgttctgttaagacgactgttttcggttgatagcagtgggcttcagggtattggtctttggtatgacccttgagtagtggcattttggcattgatgaggcttaggatgatggttcgctatatttctaacttcagggagaagtacatgagtaataaatcattccgcgtcacgttcactcgcggcgatagctcttctgttattaccagtaccgtacaggcttcgagcgctagccaggccaaggaaaaaatcaaggaaagagagcgtggcaaagccaagatcatctcggcagtagagcaataggatcttaaagttcgatcgggcggagagggatgatgatctgctccgcctttattagccatttcaagatgttgttcgatagcgctgatggagttgcattatggaagatgaagaacagcaggaaaaacgttcgatctattacgatttgggcgacgcctataacgatgtgaaaggcgccaatggtgcaaaggaaacagcgatcactggtgccgcgttagcgggtaagacgctatttaacacatcgatctgggcagggaagctggggatcgaaatgatcaagaaccttcccgaagccgtagaaaaacaacgtgagagaatcgaggccgaaaaggctaaaaagtaatcgtcataaggggcttctgtgagccccgatccaacagggtattctgcccgccgcatgacccgatcagtctagacaggtagccgctagcggtgagtcaaacttgcgcagttgatcactcatcctcgcccgtgctgggggacgccttggcctccagtagatcttgccttcccttgcagcagatcaatgtccgttctcttgtgtcgccatttcttgctttacgacaaggaaagttgcgcgcacttgccttgcaatgccccatcgttgattggcaaggagaggctgcaatgagtgtttttcgaagtgtattgggggcctgtgtgctgcttggcagctgtgccagcagcctggtcctggccggtggggccgagggtttgcagcgggtgcaggtcgagctggtcgcaccgccgctggttcatcctcatgagcaagtggtcagcgggccgcccaaggtggtgcagttccgcatgagtatcgaagagaaaaaaatggtcatcgacgaccagggcaccacgctccaggccatgaccttcaacggctccatgcccggcccgacgctggtggtgcatgagggggactatgtggagctgacgctggtcaacccagcgaccaacagcatgccccacaacgtcgactttcacgcggccactggcgccctgggcggggcgggcctgacccaggtggtgccggggcaggaagtggtgctgcgtttcaaggctgatcgcagcggtacctttgtctaccattgcgcgccgcaaggcatggtgccgtggcacgtggtgtcgggcatgaacggcgcactgatggtgctgccccgtgacggcctgcgcgaccctcagggcaagcccctgcattacgaccgcgtctacaccataggcgaatccgacctgtatatccccaaggacaaggacggccactacaaggactacccggacctggcgtccagctaccaggacacccgggcggtcatgcgcaccctgaccccgagccacgtggtgttcaacggccgtgtcggcgccctgaccggtgccaacgcgctgacctccaaggtcggtgaaagcgtgctgttcatccattcccaagccaaccgcgacagccgtccgcacctgattggcggccatggcgactgggtctggaccaccggcaaattcgccaacccgccgcaacgcaacatggaaacctggtttatccccggcggctccgcggttgcggcgctgtacaccttcaagcagccgggtacctacgtgtacctcagccacaacctgatcgaggccatggaactgggggccctggcccagatcaaggtgcaagggcagtgggacgatgacctgatgacccaggtaaaagcgccggggccgatcgtcgagagcaagtaataggaggacgggcgggggatattgctcgggtcttgaacatttcgtgaaagtccgtaatatcctcgccatgctcatcgaccaaatcaaagccctggccagcgacatccgtatgcagatgctcgaatggctgaaggacccggaaggcaacttcccgccccaggggcatgacgcgccgaaagaaatcggcatctgcatgactcacctgcagcacaaggccgcgctttcggcgtccagcacgtccagccatctggcgattctgcagcaggccgggctggtcgaggccacgcgtatcggcaaatggacttactttcgccgtaacgaagcggccattgctgcttttgccgagcaactgaagcgcgaactctgagtttttttacttgaacatttcgttatttttcgaaatgaaaaggcaacccaggaggatctgttcatgaaagcaatctacgtacaacccggtggtggctacgacaacgtagtggttggcgaggctccggccgcggcgccacaagcgggcgaaatcaccgtgcgcctgcgcgccagctccctcaactaccacgatttcgcggtggtcagcggcatgtgggggccgactgagtcgcgcattccgatggccgatggcgccggtgaagtggtagcggtgggcgagggtgtcagtgaattcgccgttggcgactcggtggtcagcaccttcttccccgaatggctggacggccggcccaatgtcataggtttcgccacggtgccgggcgatggcctggatggttacgcccgggaagtcgtcaccgcccgcgccaccgccttcacccgtgcgcccaagggctggagccacgccgaagcggcgacccttaccaccgccggccttaccgcctggcgcgcgctggtggacgacggccgggtgaccgctggcgataccgtgctggtgcaaggcaccggcggcgtgtcgatcttcgccctgcaattcgccaagatgctcggcgccaccgtgatcgccacctcgtccagcgatgccaagctggagcggctgaaagccctcggcgccgatcacctgatcaactaccgccaggacccgacctggggtgaaaccgtgcagaagctcaccgccggccgtggcgtcgaccacgtgatcgaagtgggcggcccctccaccctggagcagtcgatgatcgctgcgcgggtcggtggccatatctcggtaatcggcatcctgaccggggttgccggcgagttcccgatcgtcaccgcgctggtcaagcaactgcgtctgcaaggcgtgctggtgggcagccgccggcagcagcaggacatggtccgcgcgatcgacgccaacggcatgcatccgatcctcgacaagcacttcgccctggacgcgatggtcgatgccttccgctaccaggaaagtaaccagcacttcggcaagatcattctcgatatctgatcctgcctggccggccgccgcggatcactcgctctgatccgtggtggccagcacttcgttgatcttccagcagcctttgtccttgaccagcagcaggtcgacgatctgcgtggtatccggcgtattgcccagggtcaccgactcacgcgccgaggtgccttgcacctgcggttcgctgaccttgatctgggtcagccactcatccatgtagtcctgggtcttgaggaagtagtcctcttccaggccctcggggctgctcatctgcttcttgatccgttcgatcagcgtttgcgtgacgtactgctgcaggtgcggcaggtcatcggtgatcgggtctttttcgttgctgaaactctgcaggtaccagttgtagaaggcctcggccaccggcttgggcgagctggcgcagtcggcgaaggcgaggggctgatggaaagccgcggcgaggagcagcagggggaacagctttctcatggggacgtccttacaggagttaagacattgagccgttgagacatcaggtttatggccgagtgctcgatttcaacacgctgcgtctcggatcgctatcggcctgtgcgccggcagcgatttgcaatacaaatacactttcaaatgctgtagtcttgaaactacagtcgcgggatgatcgagatcaaacagaccgcgacctttatggagtgggaaaacaggctcaaggattccagagccagggcgttgattgctgcgcggatttttcgcctggccaacggtcttgccggggacgtgtcgccggtgggcgaaggcgtcagcgagctgcgcatccattacgggccgggctaccgggtttacttccagcagcgcggcttgcaactcgtcattctgttgtgcggcggcgacaagagtcgccagggccgcgatatcgaactggccaaacagctggcccgtcgttggagccgatcatgaacgaaccgcttttcgactatgaccccgccacggccctgcgtgacccgcaagccattgccctgttcatggcggacgccttcgagaccggcgatgccggctacatcgccaaagccctgggcgtggtggcgcgggccaagggcatgaccgaactggcccatgaaaccgggctgtcccgcgagcagctgtaccgctcattcagcgacaagggcaacccgaccctgaagaccctgctggcggtgatgcgtgcactggggctggacatgacggcgcgggtgcatggggcgtcttgattgatggccgggtcgagccgccaatgtcggggtgggcggccctgtccagcgcctggcgggaactcatggcgcacggggcgaatgagcttcgccccgttccagtgtttgccgatttttaacgccccgcgccagcctcggccggccggttggcgtcgagcaacgcgctcactacggcattggccatctccaccgagtggatcatcgaccaaatcagcccgcgctccacaccgctggcgcgttcgctgatctcgtcgctgacctgtaccgcgcaatccagtagcagcgacacatgcaccaaggcttcttcggcgctgacgccggggcggacgctgaacagggcgtcacagcccacggctgtcgggacggtggctttcaggttgccgaggattgaggtttcagcggtgttcgcggccagggccaggcggatgcgctgggtggcgaggtcgtgttcgggggttctgaattgcccgggcatgggcggatcggggacgagctttttcatggtgcatctccaacgtgagtggagctgccagatgtcgctgctaaacgatggggtggcagctgtacgcaggttagcaggccggtcacattggaaaaccggcgcatccgaagatgccctgcgcacagccaccatgacaggcagaataaaaaatctaccgaccggtgacatcgatgcgcccaatgtgatgtttcgagctgctaaacccgatcactgaataagcagtgacaggccgagcctagacagcaggtttcacaggcgcaagcgggtgggagtttctaggaaaagtcgctcaatagaaagcgaagaaccttacttttgccggggcagaaacggctgccgatgacctgtccgatcctgtcgagttgcgcattgaacatggttttccaggcattaaaaagccggcttgtggccggcttctcggggactggcttggttcatttttggtaaaccgcaccagcctgcaaaacgtacacccagctcttgcggctggctgtgggacttggcgagaaaatcatctgccgcgtcgggcggatctgaccggttgaacaggtcgatgcgcaaaggtggggcgcagcatactgatattcgaagagaattcccagcgcaaagcgttagccggagcctgtgacgagggcaaaaagcaggggtgtttgtatcggagggcgttgttggcggggaatggggggttgttatcgcgggcaagcctcgctcctacgggggagggggcattcgacaggcacaaaaaagccccgggtcagcggggctttttattgaaggggtgcttagcctttgtaggcggcaaccgacttcaggatcgcggcgcgggcggcgtcggcgccgtcccagccttcgatcttcacccatttgcctttttcgagatctttgtagttcgcgaagaagtgctcgatctgctgaatcagcagcggcggcaggtcggtgtattccttcacgtcgacatacagctgggacagcttgtcgtgtggtacagcgatgactttggcatcgccgccgccgtcgtcggtcatgttcaggatgccgaccggacgggcgcggatcaccgagcctggagccactgggtaaggggtcacaaccagcacgtcgagggggtcaccgtcgtcggccagggtgttcgggatgtagccgtagttggccgggtagaacatcggggtggccatgaaacggtcaacgaacaggcaatcgctgtctttgtcgatttcgtatttgatcggcgcgtggttggccggaatctcgattgcgacgtagatgtcgttcggcaggtctttgccagccggaatcttgctgtagctcattgggcgatgcccccgttagttgaccaaaatgtcttggccggattgaccaaaaagtggcggcgattataggcatattccaagggctatgccacgtaccgaaggacgtatggacgccttgggccaaacgccgcgaaccctgtgcaggagccgtcggtcgacgctcgattgcttgcgaaaagaagagtcgccgcagcctgtttagttcagagacacccgtcaggatcgacgattatttcgccagcgggcgcgttccggcaggacgcctcagtgttgctggtagtgcgggtcgctggcctgcaattgctggagccgggccaggggattctgccggtaaaacagctgcagttgctggtagaccttcggataggcctcgtgcagcagatccggggcgctgaagaagtattcgctggtgacggcgaagaattccgcggggttttccgcggcgtaagggtcgatggcggtttcggcgtccgggtcgtggtcgagctggcggttgaggtcgtcgtaggccgcctgcatcacctgcgcccagtcgctgatgcgcatgtcgctgtgcagcggcggcaggccgttggcgtcgccgttgagcatgtccagcttgtgcgccagctcgtggatcaccaggttgtaggcttcccagccgccgctggcgagcacgccgggccaggccaggatgatcgggccctgttgccaggcttcgccgctgtgttcgccgtcccattcatgttcgacgccactggcatcgcgatggcgctgggggctgaggaagtcgtcggggtagaggacgatttcgtggaagccctggtaccagttcaaatcccccaggtgcaacagcggcaactgggcctgggcggccagcagcaggcgttcgaactggtgcagctcgaccccgggcagggcgctcaggtgcttgtcgtcgagaaacaggacgctggtttcccgcagccattggtcctcggcatcgctcaggccgtcgagaaagggcaggtgctggcgcacccgttgccacatttcatcggcaaccgggtgcttggccagccgacgccggcggcgccaggtactgaggggccacatagcgatcagtggctttcagcctttgccgccgagcggcccaggcggctgcgcaccacgccgatgatcatcggcaccagcgacagcaggatgatgcccaccaccagcagcgacaggtttttcttgatgaacggcacgttgccgaagaagtagcccagggtcaccaggccgccgacccacaggatggtgccggccacgctgaaggcgaagaagcgcgggtacggcatcttggccacgccggcgacgaagggggcgaaggtacggatgatcggcaggaaacgcgccagggtcacggttttgccgccgtggcggtcgtagaagtcgtgggtcttttgcaggtagtcgcggcggaagatcttcgagttcgggttgctgaacagtcgttcgcccaccgttcgcccgatgatgtagttggtgctgtcgccgaggatcgccgccagcatcagcaggccgccgagcagtaccgggtccatggcgccaccggcggcgaccgcgccggcgatgaacagcagggagtcgccaggcaggaacggcgtcaccaccaggccggtctcgcagaaaatcaccaggaacaggatggcgtagatccatggcccgtagttggtcaccaacatgtcgaggtaaacgtcgagatggaggatgaggtcgatcgggttgaaatccattggggcacctgtggtgacggcccgactctgcgggcctgtgcgatgactggggcaaaaaacttacagctggcgcagattcatcttacgccccgaaaaggtcggcattataagacctgataggtgaaatgggcgttgagtttgtagcgaggaatgtattgacggcgctggctggccagaggcgaaagatcgtggccttcggcagcgtcttcccaggcactgtcgaaggtcgtgatcgggcggttggggggcttagtcgtcgctgatcggcaatatgtagttcttgaactgggtatcttcgcgaaaaccgatggattcataggttttctgtgccacttcgttgtcactgctggtggagacacgcatgcgtacggcctgggtgtccttggccattttcttcgcggtacggatcaggttgtcggccaccagttggcgacgggcatcttcggcgacgtagatgtcgttgaggatccacacgcgcttcagggacagggaggaaaaactggggtagagctgacagaaaccgaggagtttcttgtcgtcatcgtcgggcagggccaggtagatcaccgactccttgcggcgcaggcgcttttccaggaaggcccgggacgagtccggaaaaggcagggcgccatagaactcgcggtatttgacgaacaggggggtcaacagatccaggtgttcgagggttgcttgagtaatccgcatgagttgtcctcaacttcgaatggatacgacggcaaacggttcattactcgggcagccgtgtttcgatgctgcctaaagcctggaaaaagcgcaatcgtctcgaaaagtcatggttttgcaggccccagcaggaaattgcccttggtggtgtcgggcgcgtcgctgtccagggtgttcacctgggcctcgtctttcaggttgacccccgagagctgccgcctgcaggcctcgcgcatcaggtacagcaagcggtgggccgccatgccgtagctcaggccctccaggcgcacgttggaaatgcagttgcgataggcatcggtgagcccgaccttcgggttgtaggtgaaatacagccccaggctgtccggtgagctgaggcccgggcgttcgccgatcaggatcacggtcatttttgccccgagcagctcgccgatttcgtcggccaccgccacccggccctgttccacgaggatgaccggcgacagcgaccagccttcggccgcggtctgttcttcaaaacgggcgagaaacggcagggtatgccgatgcaccgccagcgccgacaaaccgtccgccaccaccaccgccagatccaccccgcccggattggcggatgcgtgatcgcgcagggcgttggctgacgcgtcgctgagcttgcgccccaggtccgggcgttgcaggtagctgtggcgatcgctggcggcgctgtgcagcagcaggctgtcgcggccgcgttcggccagttggctgctcaacccggcatggtcgaagggcaggtgtaccgcatcgcgggcctgggcgtgggcgaactggaagtccagctgggcgccggtgggcaggctggtgccggtgcggcccagggcgatacgcgccggggtcaggcggcgcagctccagccaggggttctggctgtcggtcggatgtttgtccatgagcctgtccttactgaagctgtgccagcgcctggcggaaggccggcggcaggttgtggccgaactgcaccttgccgtcgggctgggtgaagatgccggttttcgccagccactgctcgaactccggcgccggtttcaggcccagggtctggcgggcgtagagcgcgtcgtgaaaggaggtggtctggtagttgagcatgatgtcgtcggagccggggatgcccatgatgaagttgatcccggccacgcccagcagggtcagcagggtgtccatgtcgtcctggtcggcttcggcgtggttggtgtagcagatgtcgcaccccatgggtacgcccagcagcttgccgcagaaatggtcttccaggccggcgcggatgatctgcttgccgttgtacaggtactccgggccgatgaaaccgaccacggtattcaccaggaacggcttgaagtgccgggccacggcataggcgcgggtttcgcaggtctgctggtcgacgccgaagtgggcgttggccgacagcgcgctgccctggccggtctcgaaatacatcaggttctgccccagggtgccgcgcttgaggctcaggccggcctcgtagccttcctgcaacacattgaggttgatgccgaagctggcgttggctgcctcggtgccggcgatcgactggaacaccaggtccagcggcacgccacggttgatcgcctcgatggaggtggtgacatgggtcagcacgcaggcctgggtgggaatttcataacgctggatgatggcgtcgagcatttccagcagggcgcagatcgaggcgatgctgtcggtggccgggttgatgccgatcatggcgtcgccgttgccgtagagcaggccgtcgagaatgctcgcggcgatgcccgctggttcgtcggtcgggtggttgggttgcaggcgggtcgacagccgcccacgcaggcccagggtgccgcggaaccgggtgaccacgcggatcttttgcgccaccagcaccaggtcctggacacgcatgatcttcgacacggcagcggccatttccggggtcagcccgggcgccagagcgcgcaggctctgttcgtcggcggcgtcgctgagcagccagtcgcgaaagccgccgaccgtgaggtggctgacggtggcgaaggcggccttgtcgtgggtgtcgatgatcaaccgggtgacttcatcggtttcgtagggaatcagcgcttcttcgaggaagtgcttgagcggaatgtccgccagggtcatttgcgcggcgacccgctcgccgtcgttgagggcggcgacgccggccaggaagtccccggagcgcgccgggctggccttggccatgacctccttgaggctgtcgaagcggtaggtctgggcgccgacggtgtgggcgaaacttgccatacaggttctccgtgacgacgcaggggcgtggcccctgcgtcgaggttttcggcggttagtgcaaggcttcttcagctttctgaatggccgcgaattcttcttcgggcgtgcctgctaccaagtgatgccgactgtagaaagcaaagtaagcaattaatactccatagatgatcgcggcgccaatgaccacccgcggatccaccaggaagcccgcgaccacggcgatgcaggccagtaccagggccacgccggaggtgaagatgccgcccggggtgcggtacggacgatccattttggggcggcggatgcgcagggtgatgtgcgcggccatcatcagcacgtaggagatggtcgcgccgaacaccgccaccaggatcagcaggtcgccctggccggtcagcgacaggccgaaaccgatgatgccggggatcaccagcgccaggactggcgccttgctcttgttggtttccgacagcttgcgcggcaggtaaccggcgcgggacagggcgaaaatctgccgcgagtaggcgtagatgatcgagaagaagctggcgatcaggccggccaggcccaccaggttgacgaagctgcccatccaggtcgaaccgccgtaggccttggccagggcttccaccagcgggttgcccgaggtcagcagggcgttggcccccgcgccgcctgggccgatcaccaggatcagcagggcgaagctcagcagcaccagcatggcgccgatcaggccgcgcggcaggtcgcgcttggggttcttggtttcttccgcggccagcgggacgccttcgaccgccaggaagaaccagatggcgtagggaatcgccgcccacacaccgacataaccgaacggcaggaagctgctggcgcccacggcctcggtgaccgggatgtccagcaggttggccaccgagaagtgcggcaccatcgccaccaggaacacgcccagggccagggcggccacggcggtgatgatgaacatcagcttcagcgcctcgccgactccgaagatgtggatggcgatgaacacgatgtagaacgccaggtagatcatccagccgccgatgccgaacagcgactggcaataggcgccgataaacaccgcgatcgccgccggggcgatggcgtattcgatgaggatcgcggtgccggtgagaaagccgccccaggggccgaaggcgctgcgggcaaaaccgtagccgccgccggcggtggggatcatcgaggacagctcggccagggaaaagcacatgcacaggtacatggtggccatcagcagggtggcgaggaacatgccgccccagccgccctgggccaggccgaagttccagccggcgtagtcgccggagatgacgtaggccacgcccaggcccaccagcaggacccagcctgccgcgccttttttcagttcgcgttgttggaaatagtcggagccgactttttcaaagtcgacggaagagccagccgactgcacgccggtatgttcgctaggcataagggttcacctgttcttattgttgtgcccggtcggcagaccggatcggtgttgcaaggcgatggagtgttctgccttgaggtcgtcatcgcgagcggcccccaagggtgaaaccgcgttggcggcttcacccttgtccctggctttactggctttagaagaagcccagcgggttgatgtcgtagctcaccagcaggtttttggtctgctggtagtggtcgagcatcatcttgtgggtttcacggccgacgccggacttcttgtaaccgccgaacgccgcgtgtgcggggtacaggtggtagcagttggtccacacacgaccggccttgatcgcccggcccatgcggtaggcgcggttgatgtcgcgggtccagaggccggcgccgaggccgaactcggtatcgttggcgatggccagggcttcggtttcgtccttgaaggtggtgatgctcaccaccgggccgaagatttcttcctggaacacgcgcatcttgttgtggcccttgagcagggtcggctggatgtaataaccgctggccaggttgccctcgagtttttccaccttgccgccggtcagcagttgcgcgccttcgcccttggcgatttccaggtacgagaggatcttgtcgaactgctgctcggacgcctgggcaccgaccatggtgtcggtgtccagcgggtcgccgcgcttgatctgctcgacctttttcatcaccacttgcatgaactcgtcgtagatcgactcttccaccagggcgcgcgacgggcaggtgcagacttcgccctggttgaagaacgccagcaccaggccttcggcggccttttcgatgaagctcggttcggcctgcatgatgtcggcgaagaagatgttcggcgacttgccgcccagttccacggtggacgggatgatgttctcggcggcgcatttcatgatgtgcgagcccactggcgtcgaaccggtgaaggcgatcttggcgatgcgcttgctggtggccagggcttcgccggcttctttgccgaagccttgcaccacgttgagcacgcccggcggcagcaggtcgccgatcagctccatcagcacgcagatgcccagcggggtctgctcggccggcttgagtaccacgcaattgccggcggccagggccggggcgagtttccaggcggccatcaacagcgggaagttccacgggatgatctgcccgaccacgcccagtggttcgtgaatgtgataggccacggtgttgccgtcgatttccgcggcgctgccttcctgggcccgcaggcagccggcgaagtagcggaagtggtcggcggccagcgggatatcggcgttgagggtttcccgcacggccttgccgttgtcccaggtttcggtgatggccagcagttcgaggttctgctcgatgcggtcggcgattttcagcaggatcagcgagcgggcctgtgccgaggtggcaccccaggcatcggcggcggcatgggcggcgtccagggctttctcgatgtcttcggcggtggagcgcgggaactcggcgatcggttggccgtttaccggcgaggtattggtgaagtactgacctttgacaggcgcgacgaattcgccgccgatgtagttaccgtatttgctcttgaacgaaacgatagcgccttcagtaccggggtgtgcataacgcatggtgggtatctcctggcttttgtgcttataggggaggacgcgctgttgcgcttgtaaaagcgtagagcaaagcccgggccactgcgttgcaggccaggaaaatcaagggtttgcgaatgtttcagcgactgcgcgccgggcgtatgtggcagttgtggcacaggccgggtgacactttgtaccgcttgtggcacagcccgtgactcattggtcgaggcagcattgcaatgcgtccatggctggaggatgctggtgggccgcgaggatctgaagaactcttctgtagccgctgccgcaggctgcgaacgaccgcgaagcgggcgctgctcttcagatcgcggaagcccctgcggggcttggcgcagcctgcggcagcggctacaggtgggtgccttctgagcagtcagcgcagcaggagaacaataagaaatgcacagcaatcacctcacccggcacgcccagcaagtgctgaccgtgacccaaggcaaggcccatctgcaggggcccggcagcgatccttccatcgcccgctcctggctgcgttgcctggaggactatcacctcgacccggccctgagcatggcgcccaccgtgctcgagcacggccgcctgctggaaagccgcgaacgcctgcagcaggtgctgcagatcgccggcaacgagatgaccagcctgcaccagcagctgtccggcgccggccatgcggtgctgttgaccgacgcccggggggtgatcctcaactgcgtcaccgcgcccgccgagcgcaagattttcgaacgcgccgggctctggctcggcgccgactggagcgaggcctgcgagggcaccaacggcatcggcacctgcctggtggagcgccagtccctgaccatccaccaggacgaacatttccgtggtcgtcataccggcctgacttgctcggccagcccggtgttcgaccctcacggtgaactgctggcggtgctcgacgtttcctcggcgcgcccggatgtgtcgcgccagagccagttccacaccatggccctggtcaatctctcggcgaagatgatcgagagctgctatttcctgcgctatttcgacaatcaatggttgctgcgttttcacctgcaggccgagtccgtcggcttgttcagcgaaggtttgctggcattcgacggggaagggcggatcagcgcggtgaaccagagcgccttgaacctgctggggcatattcgcggcggcttgctgggcaaaccggtggaagcctttttcgactgctcgctggacgagttgctgggtcgcgccagtgtcaatgccagcgccagctggccgctgcgcacccgtgatgggcggcatctgttcgcggtgttgcgtggccagccgcgcagcgtaccgaaaccgctgccgccgagggcggtgctggagcgtccgcgtctacccgagatctgcctgggcgatgcggccctgcaagacgacttccgcaaatccttgcgggtgttcgagcgcgatgtaccgctgctgatcaacggcgaaaccggctccggcaaggaggcgttcgccaaggcggtgcaccatgccagccagcgggcggagaaagccttcgttgccttgaactgcgcggcaattcccgaaagcctgatcgaaagcgagctgttcggttatcgcggcggcaccttcaccggggcacgcaaggaaggcatgcgcggcaagttgcagcaggccgatggcggcacgttgttcctcgatgaaatcggcgatatgccgctggccttgcagacccgcctgttgcgggtgctggaggaccgcatggtggtgcctatcggcggcgagccgcaggcggtcaacgtgcgcatcatcagcgccactcaccgggacctgctggagcgggtacgggacggcagtttccgcgaggatttgtattaccggctcaatggcctggaaatcagcttgccggcgctgcgcgagcgcagcgacaaatcccagttgctggattttctcctggcgcaggaagccggcgatcagcaagtctcgctcgacggcccggcacgccaggccctgctggacttccactggccaggcaacgtgcggcaactgcgcaacgtattgcgcaccctggcggcgctctgcgatgacggacgcatcggcctggaggatgtgccggcgatgattcgccagggccgcccggcgccaatgccggcggctgccgatgaagcgggcggatacccgctggacgatgccgaacgcctggccttgctcaatgccctggaacaacagcgctggcatatgacccacaccgccgagcagttgggggtgagccgtaacaccctctatagaaagctgcgcaagcatgggatagcgcgctaggcgcggccccgggttatcgttcatcgcgagccttcctctgtaggtgcagccggtcgacgctcgattgctcgcgatagacggcgcagccgccgatacgtcggtaaccgcggcccaaggctccaaccgtgttcgggcgattccccggcaaaagccccacagaactcgtcacagcctccggcagcgacaaccgcgtgttcccccatcagctaaagagtgcgatttgcagccctctacgctaacctgcctcgatgttttacgaggtcgactatgcacattcatattctcggtatttgcggcaccttcatgggctcgatggcggttctggccaaagagctgggccatcatgtcaccggctccgatgccaacgtctacccgcccatgagcacccagctcgaagcccagggcatcgagttgacccagggctacgacccggcccagcttgacccggcgccggacctggtggtgatcggcaatgccatgtcccgcggcaacccggcggtggaatatgtgctgaacaagggcctgccctatgtttccggcccgcaatggctggccgaccatgtgctgcaaggccgttgggtgctggcggtggctggcacgcacggcaagaccaccaccagcagcatgctggcctgggtgctggagcatgcgggcatgagcccgggcttcctgatcggtggcgtgccgcagaacttctcggtgtcggcccgcctgggcggcacaccgttcttcgtaattgaggccgatgaatacgacagcgccttcttcgacaagcgctcgaagttcgtgcactaccgtccgcgcacggcgatcctgaacaatctcgagttcgatcacgcggacatctttcccgatctgccggcgatcgagcggcagttccaccacttggtgcggactatcccgagcgaaggcctggtcatccacccgactaccgagccggccctgcaacgggtgatcgacatgggctgctggaccccggtgcaaaccaccggcgcgggcggccaatggcaggtcaagctgctcagcgaagacggctcgaagttcgaagtaatgttcgaaggtgaggcccaaggcgtggtcgagtgggacctgaccggccaacacaacgtcgccaacgccctggccaccctggccgcggcgcgccatgtcggcgtggtgccgtccatgggcatcgctgcgctgagcgcgttcaagagcgtcaagcggcggatggagaaggtggctgaagtccatggcatcaccatctacgacgacttcgctcaccacccgaccgccatcgccactaccctggacggcctgcgcaagcgcatcggcgatgcgccattgatcgcgatcatcgagccgcgctccaactccatgaagctcggcgcccaccgtgacgggctgccggaaagcgtcaaccaggccgatcaggtggtctggtacgcgccggccaacctcggctgggacctgggcgccaccgctgcgctgtgcagcgtgccgtcgattgtcagcgactccctggaaggcatcatcgagcgggtgaagagccaggccaagccgggcacccacgtggtgatcatgagcaacggcggcttcggcggcctgcacggcaagctggccgaggcactgcgatgaacaacggcccggaacgcattaccctggcgatgaccggcgcctcgggcgcccagtacggcctgcgcctgctcgattgcctggtgcgcgaagatcgtgaagtgcacttcctgatctccaaggccgcgcagttggtgatggcgaccgagaccgatgtgaccctgccgtccaagccgcagaccatgcaggccttcctcaccgagtacaccggtgcggcagccgggcagatccgtgtgtatggcaaggaagactggatgtcgccggtggcctcgggctccggttcgccggcggcgatggtggtggtgccttgctccaccggtaccttgtcggctatcgccacgggtgcatgcaacaacctgatcgagcgggcggcggacgtcaccctgaaggaacgccgccagctgatcctggtaccgcgcgaggcgccttactcgagcatccacctggaaaacatgctcaagctgtcgaacatgggcgtgaccattctgccggcgtctccggggttctatcaccagccgcagaccatcgacgacctggtggactttgtcgtggcgcggattctcaacctgttgaatatcccgcaagacatgctgccgcggtggggcgagcatcatctgagcagcgatgagtaagtcgctgctggtcctgctggtcgccctgcaactgggcggctgcgccacggcacgcacgctgaacgcggccaagccgggcgcaccggtggtgtattccgggacgcgcctggatctgtatgtgatgcagggcggctgttgcccgatggatcgcttcggtgccgaagcgccgagctatccgggggtcgatctgccggccagcgccttgctcgacacgctgctgttgccgctgtcggtgctgacggtattgggggttggtttccaggctacaggcgggttgtaacgaccttgtagccgctgccaaaggctgcgatcgctcgcgtagcggccgtagaggcgggctgcgcggtggtgcggcaactcgcgtcgtcaggattgcgcctgctgcgcagtcgatcgcagcctgcggcagcggctacaggcgcgatccatggcgtttatttgcccagcttgcgcaactcgtcggactcgacgatccgcacgccatcctgctcttccagcgccaggcgccacatggcccgggccagatggcaggcttcgatgccgtggtatttgccgggaatcagcttggacagcgggccggccagctgttcggcgaaacgcggttcgatgcgttcgcccagcagcagcgacggccggcaaatagtcagttgcggccagtcctgggccttcagcgcctgttccatttcgcctttgacccggttgtagaaaatcgaggatttcgcatccgcgcccagggcgctgatcaccaccaggtgccgcgcacccatctcccgcgcgcgcttgccgaaggccaccaccaagtccaggtcgacggcgcggaacgcctgttcggagccggctttcttgatcgtggtgcccaggcagcagaacgccaggtccacccggccgctgagctgcggcaagagtaccgccgggtctccgaccgggttttccaggcgcggatgttcgctcaaggggcgccggctgggcgccagtacgcgggttaccgtgggttcgttgagcaggcggtcgagcaagtgctcgccagtaaggccggtcgcgccggcgagcaagatatgctgaggcgtcaagtacataatgtttcccccttgatactgtttcagcttagttgctctttgcttccttgctgtcgttggcggcgctttgcagcgcctttcgtgcttgttgcttgcgcagatgctgccagtgcgccaagacccccttgggcgcccagatctgcggttcggaggcttcgaaattgtccgcctgttcgcgttcggccacggtcgccctggccagcttgaaagcctgttccaggtcgtcggtctgattcagcgcctgggcgaacagggcgtcgccgaagtaggtgaagtcggcttcttccgagcagccgaacgatacgcggtcggcctgcgaagcggtcatgatcagggtccgctcatccttgagcgcgggaatgaacccgccggaataacaggccgagatcacgatgatcttgtcgcggtttttcagtggcgccagtaccgcggccaattcgtcggccggcaggtcggccagctccaggcgcggctggtcgagcaccagttcgtgttcgctggtgccgtggctggtcaggtagataaacagcaggtcttccgggccgctgcgttcggccaggacctgtaccgcgcgccgcaggttttcccgggtggccatagggcggctgtcgaggcggtcgcggtggttgaccaggcggatctggccgtaggcaccgaagcgggtggcgagcatgttgctgacatagtcggcctcgcgcagaaacacgctttgcttgccatcgccggccagcgtcaggctgtagagctcgatggcgggggtcgacgccggcaccgcgctgagggcatcgtcgagcaggcggccctgggccagcaggccggtctccagtgggtcgggcaacagtcggccgtccgcatcgcgaacccgcaggccattgatccagtcgccgctttgcacggtgccatcgcgcagcaccagcacaccgtggccctggtagttgtcgccttcgaagccgccgatatagaagctgccgtcgctgaggttcaggcggccctggccgctgaagcgccagtcgctgaaacggccgatgtagtggctgccgtcgacgccgatcagctctcccttgccactgagggcgccttccttgaactggccgatccagacatcgccgtcggcgttttcgtagcggcccttgccgctgagctggttctgtttgaagccgccgacgtagagatcgccctcggcgctgctgaaggtgccgttgccttccagctggccatcgacgaagtggccgctgaactggttgccgctggcatcgctgcgctggccttcgccgttgggtttgccgcgggagaactggccctggtactggctgccgtcttccagttcgagacgaccgagcccggaatacaggtcggacttgaattcgccgcggtaggtcatgccgcgttccttgagggtgccttcaccgtcgcgccggcccagtttgaaaccgccggtatagctgctgtccttggtgatcaggctgccctggccgtggaacaggccctgctggaattgaccgcggtagacctcgccgtcgctgccgtgccattcgccctggccatgccattggccgctgtcgaactggccggcataccagctgccgttggggtagtcgatgcgcccctgcccctgcagcaacccgttgaccacatcgccgcggtagcggccaccgtccggcagacgggcgtcgggaggcagcagcgattcgccgtctccacatgcggtgagcaacagggtcagagccaggggtacaagtgggtgcatagcgggatccggataattaggggaccgagtatgccgcagcagcgaggcttatatatagagaggctgcgcgaaacagcgtgagctgtttcgcatcaggaaggtttcagacaaagcagagggacaagggctcggcgatgtaggctggtttttcctggccttcgatttccagtgtggcggtggccttgagcagccattggccgggtttcttctcggtgacttccaccaggtcgaccttgaggcggaccctggaatcgaccttgaccggctggatgaagcgcacgctgtccaggccgtagttgaccaccatcttcagaccctcgggcaggatcaggatgtcttccatcagtttcgggatcagcgacagcgacaggaaaccgtgggcgatggtgccgccgaacggcgtctgggcggctttcaccgggtcgacgtggatgaactggaagtcacccgtggcttcggcgaacaggttgatacgctgctgatcgatggtgagccattcggaacgtcctagttcctttccgacataatctttgagctctgcaacaggaacatacggcattgagactctccttgggttcatcggttttatcgttctaaaggggcgggggccgtaccccctgaccacccactgtagatcatcatgggggtttgctccggtcaaccttccatgcttttggcgaatgccggtccatagcgttcgcgtgcttataatgcccggcgttttttcgggggagatgagagatgttgttacgcggtctgacatggctggtgctgtttcaattgctcggcacggcgatcaatcatctgttcctgccgatcctgccggggccgattgtcggcctgctgttgctgctgatcttcctggtggcacgcggcgaagtgggcgagccgctgaacctggccgcctccagtctcttgcgttacctgccgctgttgctggtgccgcccgccgtgggcgtgatggtgtacgcggcggatatcgccgcggacttctgggcgatagtcggcgcgctggtgttgtcgctggtgatctccatggccttcgtcggcgtgctgatgcagcggctggtcaagcgccacggacatcgggagggcggccaatgatgttcgattggcagggcgcctgggcgtcggtgatccaccatccattgttcggcatcggcattaccctgggcgcctatcaactggtgctcgcggccttcgagaaaacccgttggatctttctgcaaccggtgctggtctccatgttgctggtgatcggcgtgctgctgagttgtggtttgagctacgccgagtaccgcaagagcacggagatcctgagcattctcctgggcccggccacggtggcgctggccgtaccgctgtacctcaacctgcggcggattcgacagttgttctggccgatatttactacgctggtgattggaggggtggtcgccaccggcctgggcgtactgctgggatggtggttcggtgccgagaacatgatcctgatgaccatggcgccgaaatcggtgacctcgccgatcgccatgctggtggccgaacagattggcggtgtcgcagcgctggctgcggtattcgtattgatcaccggggtgatcggggcgattttcggtccggccatcctcaaccgcctgcaggtgcatagcccggaagcccggggcatggcgctgggcatgacggctcacgcggtgggcacttcggtggccttgcaggaaagtgatgagtgcggtgctttcgcggcgctggcgatgagtctgatgggtgtggccacggcggtcttcctgccgttggcggtgtcgttggtggtttaaggaaacctgtatgagcctggcgcttttcccgctgaacacggtgctgttccccgactgcattctcgacttgcagattttcgaggcgcgctacctggacatgatcggtcgctgcatgaaacagggcagtggcttcggcgtggtgtgcatcctcgaaggcgaagaggtgggcatcgccccggaaggttttgcgcgggtgggctgtgaagcactgatcactgacttccatcagcaggacaacggcctgctggggattcgggtcaagggcgggcggcgttttcgggtgctgagcagcgaagtgcagcgcgatcagttgcgggtggctgaagtcgagtggttggacgaggcgccggagcggccgctgcaggatgaagacggggacctgatcgccttgctcaaggcgttggccgaacacccgatggttgaagccctgaacatgggtaccgaagccaccggccagcagtcgctggccaaccagctggcctacctgttgccgttctccgagctagacaagatcgacctgttgcaactggacgatccgcaacaacgcctggatgcgatccaggccttgctggacgaattgcagggcgaactgttcgcctgatcctgatcctgatcctgatcctgatcctgatcctgtagccgctgccgcaggctgcgatcgcccacacagtgggcgcagattccgaaaccgctgaaggccttcggcctatcgcagcctgcggcagcggctacaggggcgttcgttctatctagtaggcataacgcaacatggcgtgcggcagatgcctgacggcttcgaagccgaacagcgccgtcagcgccggcaataccagccaccagatcttggccggcatgggctccagtggtgtctggcgctgggcgaaccacaggctggcggcgcacacgcaggcggcaagcatggcgccggcaaggatgtcggagggccagtgcgcgcccaggtaaatccgcgacaaggcaatcgccgccgccggcaggcagcccagcagcagccaggtcaggcgcatgcgcggcggctggccgcgaccggcgagtatcgccagggtcaggaacagggcgaacgagccggagctgtggccgctgggcatgctgtagctggtcagtgggtcggtcaggacttccgggcgtacccgggcgaagaacagcttggtgccggtgttggccaatgcggtgcccagcagcgtggtgcccgcgaaaatcgcctgccgccattgccgggcaatcagcaacagcagggtgaccagggcgctggcgaacagcatggtgcgaaattcgccgaactgggtgagtaccaccatcacctcgtccattgccgggctgcggtgttcctggactagcgcgatcaagccctggtcgaaatggttcaagtaggggtaaccgatgaacagtcctgccaggatcgccagactgaggccggccaccagcgggctggccttgcgatggcggcgcacggtgctattgatgctcaggcccagcagcacggcgatgctggcggcgactattcctgcctgcggccagaaaccttcaggcaagggcaggcggatcgccgcgcccgtggcccagcctggcagcaggtaggccacggtccagccggccgcggccagcaggctgacggcgaaaaagcgcgggaacgacatgtcgaacatcccggcgaccatcggcagcatgggccgcaaggggccgataaagcgcccaaccaacaggctggcgatgccataccgctggaaataggcttcggcgccgttgatccattccgggtgatgccgcaggcccggcaggcggcggatattctggtggaaacgccggcccagcagataagacaccacgtccccaagcaagccgccaaagaaccccagcgccagggtttcacccagggacagtgcgccgctgccggccatcacggcaatggcgaacagcagcacggtgccgggtacgatcaggccggcaatcgccaggcattcgacgcaggcgacgatgaatacggctgccgccagccattgggggttcatcgtcagccagccggttattccatcgagccattggcccataggttttcaactccggttattcggtggttcaactgtagaaacgggcttgctcgcgatcaggccatccgcgggcacgccggctcctgccaaagggatcaatcgagcaacaaatagtcgcgaccttcgacctgcccgcgacgtagcgggttccgggtgcagtagggggcgtaggcggcatcgacaaagcggtacatcaagtgttcgtcgcggccgtggggaatgcccaggcgagtggtctggatgatgctggcgacgggcgtgccgacatcctcgacgaacagcacttcatggtcgaagcgcttggcatcccataccgggactttcaggcccagcgccttgcacagcagggtctggccggcgcagagcttttgcgaggggcgcggccggccgctggcatcgggattgttcagcagcatctgcgccaggctggcggggccggagacttcgtcgatccaggggtaggccgacttgatcagcaccgcgttgcccggcccctgggcgctgaagttcagcgaatcgccgccgcgggcgtagtacatatagatgtggccgccgtccagaaacaaagccttacgcttttctgtgtagccgagggaggcatggctgcctttttcctcgcagtaataggcttctgtttcgataatgcgcgccgacaaccacagatcgccgacccgatggcggatgattttgccgagcagttcacgggccaggacctgggcatcacggtcgaaaaaacggtcgggcagggccttgggcagcgtcggggtggacagaatggacatggtagccaggagcgatgacgggaattggttcggaatgatatcaattccaggcttaattcaggctgaacgagaggtatttgccgtccatttcgaccatccgcccgtgaccgctgtccgtggaccggcgcgacagctataatcagccgctttcctctttgccaagaccacagcagaccatgactgagtccgttcttgactacatgacccgtttgggtcgcgctgcccgcgaagcctcgcgggtaatcgcccgtgccaccactgcgcagaaaaaccgcgcattgctggcggctgccgatgcattggacgctgctcgccccgagctgagcgcggccaatgagcaggacctggccaacggccgggccaatggtctggaaccggcattgctcgatcgtctggcgctgaccccggtgcgtatcgacgaaatgatcgaaggcctgcgtcaggtggccaagctgcctgaccccatcggtgaaatccgtgatatgcgctacctgccttcgggcatccaggtcggcaagatgcgcgtgcccctgggcgtgatcggcatcatctacgagtcgcggcccaacgtgactatcgatgcggccagcctgtgcctgaagtccggcaacgccaccatcctgcgtggcggctccgaggcgatcaattccaaccgcgccattgccacctgcatccagcaagggctggcggtggccggcctgccggcgcaagtggtgcaggtggtggaaaccaccgaccgcgcggccgttggcgcgctgatcaccatgcccgagttcgtcgacgtgatcgtgccgcgtggcggcaagagcctgatcgagcgggtcagccgcgacgccaaggtgccggtgatcaagcatctggacggcgtctgccatgtgttcatcgacgtggcggccgacctggacaaggcgattcgcatcgccgacaacgccaagacccagcgctacgcaccctgcaataccatggagaccctgctggtccacgccggtattgccgagcgcgtactgccgccgctggcggcgatctatcgcgacaagcaggtcgagctgcgcggttgcccgcgtacccgtgccttgctgggcgacgatgtgatcgaggccaccgaagaagactggagtaccgagtacaccgcgccgatcctgtcgatcctggtggtcgacagcctggacgcggccatcgagcacatcaacatctacggttcgcaccacaccgacgccatcgtcaccgagaacttcaccgacgcccggcgtttcctcaacgaggtggattccagctcggtgatggtcaatgcctcgacccggtttgccgacggtttcgaatatggcctgggcgcggagatcggtatttccaccgacaagctgcacgcccgtggtccggtcggcctggaagggctgaccagcgagaaatatgtcgtcttcggcgacggccatgtgcgcacttgatgagcaaacgtatcggtctgctgggcggtaccttcgaccccgtgcacatcggtcacctgcgcagtgcgctggaggtggccgattcgctggggctcgatgagctgcgcctgacccccagcgcgcggccgccgcatcgcgatgcaccgcaggtgtcggcgctggaccgtctggcgatggtcgagtgtgcggtggcgggcgtttcacccctggtggtggacgaccgcgagctgaaacgggacaagccgtcctacaccctagacaccctggaacagatgcgggccgagatggccgcggatgaccagttgttcctgttgctgggctgggacgctttttgcggcctgcctacctggcatcgctgggaagagttgctccagcattgccacatcctggtgctgcaacgcccggatgccgacagcgagccgccggatgcgttgcgcaacctgctggcggcgcgctcggtgagcgatcccctggccctgcaagggcccggaggacacattgcattcgtctggcagacaccgctcgcggtgtccgccacccagatccgtcaactgctggccagcggtaagtcggtacgtttcctggtgcctgatgcggtcctggcctatatcgatgcacacggtctttaccgtgggccgaactgaaggcgcgctgccggctgatgccgtgcaacgcgccatacatacgagctgaacgagttttatatgactaaccaagtaatgaaaggcgaagatctggtcaaggtggcagtcgccgcgctggaagacgtcaaggcccaggacgtcctggtgatcgatgttcgcgaaaagcagagcatcaccgactacatgatcatcgccaccggtacttccaaccgccagatcggcgcgatgctggaaaaggtccgcgagatggtcaaggcccagggcgtcaagccgctgggtgaagaaggcaagggcgacagcgactgggtgctgctggacctggacgacgtgatcgtgcacatgatgaccgcctccgcgcgccagttctacgacctggaacgtctgtggcagggcgccgagcagagccgtgcggccgatggcaagcaccacagcccggagcacacccatgagcacttcaccaagctcaacaaagaccagcaataagggacggctgtgcgcctgcgtctgatcgctgtcggttcacgcatgcccaagtgggtggaagagggttggcacgagtatgccaagcgtctgccatccgagctggcgctggaactggtggaaataccgctcaatacccgtggcaagaacgccgatgtggctcgtttcatccgtcaggagggcgaagccatgctggccaaggtcggcccgaacgagcggatcgtcacccttgaggtccacggcaagccctggagcaccgagcaactggcggtggagctggatcgctggcgcctcgactcgcgtaccgtgaacttcatggtcggcggccccgaggggctggcgccggaagtctgcgcgcgggcggatcagcgctggtcgctgtcgccgctgactttgccgcacccgctggtacggatcctgatcggtgaacagctgtatcgcgcctggacagtcctgtccgggcacccttatcacaaatagtccgcgcccctaatgtcccagccgatccgtatcaaggaccacgaaaaagacgcccgtctggtgcgtggccgggtcgtgttcggggctattgccgtggtctgcctgatcggggtgctgatcgcgcggctgtattacctgcaggtgatccagtacgactatcactcgaccctgtcggaaaacaaccgggttcacgtccagccgattccgccgacccgcggcctgatcttcgaccgcaatggcgtggtggtggccgacaaccggccgagcttcagcctgagcatgacccgcgagcgttccggtgattggcgccaggtgctcgacgtcattgtcgaggtgctggagctgacgccggaagaccgggcgctgttcgagaagcgcatgaagcaggggcgtcggccgttcgagccggtgccgatcctgttcgagctcaacgaagagcagatcgcccggatcgcggtcaaccagttccgcctgcctggggtggaagtggtggcgcagttggtccgtcattacccccagggcgcgcacttcgcgcactcggtgggctacatggggcggatcaacgagaaagagctgaagaccctggacccggtgaactacagcggcacccaccacatcggcaagaccggtatcgagcgcttctacgagcccgagctgcacggccaggtgggttacgaagaggtcgagaccaacgctcgcggccgtgtgttgcgggtgctcaagcgtaccgacccgattcccggcaaggacattgtcctgagcctggacatcaagctgcaggaagccgcggaggcggccttgggcggccggcgtggcgcggtggtcgcgctggacccccgcaccggggaagtgctggccatggtcagccaaccgagcttcgacccgaacctgttcgtcaccggcatcagcttcaaggcctatgccgagctgcgtgactccatcgatcgtccactgttcaaccgggtgctgcgcggcctgtatccgccgggctcgaccatcaagccggcggtggcgatcgccggtctcgactccggggtggtgacggcctccacgcgggtctatgacccgggctactaccaactgcccaactacgatcacaagtaccgtaactggaaccgcagcggtgacggttacgtcgacctcgacaccgcgatcatgcggtccaacgacacctacttctatgatctggcccacaagctggggatcgatcggttgtcggcctacatgaacaagttcgggatcggccagaaggtctcgctggacatgttcgaggagtcgccgggcctgatgccgtcgcgggaatggaagcgtgccacccgtcgccaggcctggttcccgggcgagacgctgattctcgggattggccagggttacatgcagtccaccccgttgcagctggcccaggccacggcgctggtggcgaacaagggcaaatggaaccgtccgcacctggccaagaccatcgagggcgaaaaaccggtggacgaaaacccgatgccggacatcatcctgcgcgatccgtcggactggacgaaggtcaatcacggcatgcagcaggtgatgcacggtgcccgcggtacggcgcgcaaggcggccatcggttcgcaataccggatcgccggcaagagtggtacggcccaggtggtcgcgatcaagcagggcgagaagtacgaccgctccaaggtccaggagcgccatcgcgaccacgccctgttcgtcggcttcgcgccggcggaaaacccgaaaatcgtggtctcggtcatggtcgagaacggcgagtccggttccggcgtggcggccccggtggtgcgccaggtgatggacgcctggctcctcggcccggatggcctgctcaagcctgagtttgccggccctatcagtgcggaggctacggcccgtgaagagtaatttcgatcgcatcctgtccagcgaggatgtgatgcgtcgccgtgcgacgctgctgcagcgcatgcacatcgacggcccattgctgatcctgctgctgaccctggcggccggcagcctgttcgtcctgtattcggccagcggcaagagctgggacctgctgggcaagcaggcgacgtcgttcggcatcggcctggtgtcgatgatcgtcattgcccagctcgagccccgattcatggcgcgctgggtgccgctggcctatgtgttcggcgtgatactgctggtggtggtggatgtcatgggccacaacgccatgggcgccacccgctggatcaacatccccggggtgattcgcttccagccctcggaattcatgaagatcatcatgccggcgaccatcgcctggtacctggccaagcgcaccttgccgccgcagctcaagcatgtgggcatcagcctggtcctgatcggtattccgttcattctgatcgtgcgccagccggacctcgggacctcgctgctgattctcgccggtggcgccttcgtgctgttcatgggcgggctgcgctggcgctggatcctcagcgtgctggccgccgcggtaccggtggcgatcgccatgtggttcttcatcatgcacgactaccagaagcagcggatcctgaccttcctcgacccggaaagcgatccgctgggcactggctggaacatcattcagtccaaggcggccattggctccggcggcgtcttcggcaagggctggctgctcggcactcagtcccacctggactttttgcccgagagccacaccgactttattatcgcggtcatgggcgaagagttcggcctggtgggcatttgcgccctgctgctgatctatctgctgctgatcggtcgggggctggtgatcaccgcccaggcgcagacgctgttcggcaaattgctcgccggcgccctgaccatgacgttttttgtttacgttttcgtcaacatcggtatggtcagtggcctgttgccggtcgtgggggtaccgttgccgttcattagctacggaggaacttcgctggtgacgctgctgtcagcgtttggggttttgatgtcgatccatacccatcgtaagtggatcgcgcaggtttgaataaggtgaagaattcaatgcaagtaatgcgtggctggactgctcggtatgcaccgtgggtcggtctggtaggcatccttggtgcggcgcaggaagcgctggccggcggcgaatacgaaggttcccctcaagtagccgaattcgtgggcgaaatgactcgcgactatggcttcgcgggcgaacagctgatgggcgtgtttcgcgaggccgagcgcaagcagtcgatcctcgacgccatttcccggcccgccgagcgggtcaagcagtggaaagaataccggccgatgttcatcaccgacgcgcgcatcgcccgcggtgtggacttctggcgccagcacgaagcggtactggcccgtgccgagcaggaatacggcgtgccggcccaggtgatcgtgtcgatcatcggcgtcgaaaccttctttgggcgcaacaccggcaattatcgggtgatcgatgcactgtcgactttgggcttcgattacccgccacgtgccgagtttttccgcaaggaattgcgcgaattcctgctgctggcccgtgaagaacaggtcgacccgctgaccctgaaaggctcctacgcgggtgccatgggtttgccgcagttcatgccgagcagttttcgcgcctatgctgtggacttcgacggtgatggccacatcaatatctggaccaatccggacgatgccatcggcagcgtcgccagttatttcaagcgtcacggctgggaagccgggcagccggtggtcagtcgggccgaagtgcgtggcgatcaggtcgacgaaggtttgaccaccggtatcgagccgacgaaaaccgtcggggagttgcgggcgctgggctggtcgagtcatgatgcgctgcgcgatgatatgccggtcacggctttccgcctggaaggtgacaatggccccgaatactggatgggcctgaagaatttctacgcgatcacgcgttataaccgcagcgtgatgtacgccatggccgtacatcagctttctgaacagctggtccaagcacggggcgtcaagtaatgctggcatcgccaaaccgcaaacccctgaagctggtggctcttgccgcgttgtccttgctggtggtcagttgttcgtcaacccaggcgccgaaacagaaaggcccgacgacagccgtacgttcgacgccgggcctggacatcaaccgcgcccacaaagacggcgcgccctggtgggacgtcgatgtatcgcgcatccccgacgccacgccgaccctgcacaccggcccgtacaaggccaacccttatacggtgctgggcaagacctatttcccgatggccgaatccaagcgttatgtcgcttcgggcacggcttcctggtacggcaccaagttccacgggcagaacaccgccaatggcgaggtgtatgacctgtatggcatgagtgccgcgcacaagaccctgcccttgccgagttatgtccgggtaaccaacctggacaaccacaagagcgtgattctgcgggtcaacgaccgtggtccgttctattcggaccgaatcatcgatttgtcctacgccgcggccaagaagctcggttatgccgagatcggtaccgcccgggtcaaggtcgagggtatcgacccgcaggaatggtgggcccagcgcggtcggccggcacccttgatgctcaatgagccgaaagccgcgccagtgatgacggcgtccacggggaccgtcgagcaatggacgccacctgcacagcagcacgccgcggccgttgtgccggtgcaactggatgcaaaaaaaaacgcttctgcgcaagcctctggccagtatctgcaggtgggcgccttcgccaacccggacgctgccgagctcctgcgctcgaagctgagcgggatggtgagcgctccggtgttcatcagctcgatcgtgcgcaatcaacagaccctgcaccgggtgcgcctggggccgatcggctcgccgggtgagatccagcaagtgcagaacagtgtccggctggccaatctggggcagccgagcctggtaaccgccgagtaataggattctgattcatggttcacctgcggtatttggagggtgaacccaggttgttggctcgtcgtacaacaaaagcccggcaagggtcagtgagtgaacaactgaacacgcgacagccctttagaaggctgtctgaatagttttgtccgcgaggacaagtttccattagcaatttcgagagacggatgaacatcaccacctttgccaaacgcctgtgtctgcttgtcccgctgatcatcacgcctgccgcctgggcggtagaagtgatgccgtcgccaccgcagctggccgccaagtcctacgtactcatggatgccagcagcggtaacgtgctggtggagaacaacggtgaccagcgcctgccgccagccagcctgaccaagctgatgacggcctacatcgcgaccctggaaatccgtcgcggccagatcggcgagaacgacccggtgaccgtcagcgagaacgcctggcgtaccggcggttcgcggatgttcatcaaggtcggctcgcaggtcactgtcagcgacctgttgcacggcatcatcattcagtcgggtaacgacgccagcgtcgcggttgccgagcacatcgccggcagcgaagacgcctttgccgacatgatgaacaagaccgccggcgacctgggcatgagcaacagccacttcatgaacccgaccggcctgccgaaccccgagcactactcgtcggcgcatgacatggcggtactggctcgcgccatcattcacgaagacccggctcactacgcgatctactcgcagaaagagttcttctggaacggtatcaagcaacctaaccgcaacctgttgctgtggcgtgacaagaccgtcgacggcctgaaaaccggtcacaccgacgaagccggctactgcatggtgtcctcggccgtgcgtgacggcatgcgtctgatcgccgtggtgttcggtaccaacagcgagcaggctcgcgcggccgaaacccagaagctgctgacctacggtttccgcttcttcgaaacccagaccttctaccagaagggcaccgagctggctcaggcccctgtctggaaaggcaccacctcccagatcaaggccggcctggcccaggacctgaccatgaccatgcccaaaggccagctgaagaagcttgctgccagcatgaccatgaatccacaattgatcgcacctatcgccaagggcgacgtgatcggtaaagtcgaagtgaaactggacgacaaggtggtgcacagcgccgatctgatcgctctggacgcggtcgacgaaggtggtatcttccgccgcatgtgggatagcatccgtctattcttctacggcttgttcaactgatattgtcgacccgcgcggccctcgctctgaaatagagcgggggccgcgtccgtcgccacggcttacgaggccgttacgccatgacagacaccgaagtaaaggcgccaaagatcgaattcccctgcgcggattacccgattaaggtgatcggcgacaccggcgtgggtttcaaggacaagatcatcgctatccttgaaaaacacgcgaccgttgactacaagaccctggccgagcgccagagcaccaacggcaagtacacgaccatccagctgcacatcgtcgccaccggtcaagaacagctgtatgacatcaacagcgagctgcgggccaccggtttcgtgcacatggtgctgtgatgcctcaaacgctgggctttcgcgagctcggccagatggcctacgagccggtctggcaggccatgcaacgctttaccaacgaacgcggcagcgacgctcccgatgaagtctggctggtgcagcatccgccggtctttacccagggccaggcgggcaaggccgaacacctgttgcttcccggggatatcccggtggtgcaggtcgaccggggtggccaggtgacctatcacggtcctggccaactggtggcttatctgctgctggacgtgcgccgcctgggttttggcgtgcgcgacctagtcagccggatggagcagtgcctggtcgagctgctggccagctacggcgtggccgcggcggccaagccggatgcccccggcgtttacgtcgatggcgcgaaaatcgcctccctgggcctgcggatccgccatggttgttcctttcatggcctggccttgaacgtggacatggatctgcagccgtttcgacggattaacccctgtggctatgccgggctggcaatgacccagctgagcgaccacacaggaccgattgaatttgccgaggtaagtgcccggctgcgtgcgcagctcgtcaaacacctcgactatgctgagcagacgaccctaacgggcggaatcgactgatatgactactgcgcaagacgctgtgcaaaccctgatcccgacgctggatgtttccgagcgcccggcccgtgcgaaagttgaaaccggcgttaaattgcgcggtgccgagaaagtcgcgcgtatcccggtgaagatcatcccgaccaccgaactgccgaagaaaccggactggattcgcgtgcgtattccggtttccccggaagtcgaccggatcaagcaattactgcgcaagcacaagttgcacagcgtctgcgaagaagcgtcctgcccgaacctgggcgagtgcttctccggcggtaccgcgaccttcatgatcatgggcgatatctgcacccgtcgctgcccgttctgcgacgtcggtcacggccgtccgaagcctctggacgtcgatgagccgatgaacctggcggtggccatcgccgacctgcgcctgaagtacgtggtaatcacctcggtcgaccgcgatgacctgcgcgacggcggtgcccagcacttcgccgactgcatccgcgaaatccgcaagctgtcgccgaacgtgcaactggaaaccctggttccggactaccgtggccgcatggacgtggcgctggaaattaccgcggccgagccgccggatgtgttcaaccacaacctggaaaccgtgccgcgcctgtacaaggccgcgcgcccgggttcggactaccagtggtcgctgaccctgctgcagaagttcaagcagttggtaccgcacgtgccgaccaagtccggtctgatgctgggcctgggcgagaccgacgacgaagtcatcgaggtcatgaagcgcatgcgcgagcacgacatcgacatgctgacccttggccagtatctgcaaccgtcccgcagccacttgccggtgcagcgtttcgtgcacccggacaccttcgcctggttcgccgaggaaggttacaagatgggcttcaagaacgtcgcctcgggcccgctggtacgttcctcgtaccacgccgacgagcaggcgaagctggccaaagaaggcctggtctcctgatgtaatacgcccgcaaggccttttccttgcgggcgtcatcttccgttacgcctgcgtctccctcccttcatagacttttcctgcaagcgccgtggcgtttcggcacttctgtttgcccgctttcatgtctactgtgcactagagaatccacacagggagaaccactggatgaccctccaaccgactgatgtcctttgtgcgcaacggccagtgccggcgctgccttcgcaagggctgatcggcttgattgcgcccgccgggcccgcagccctggacactgagcaagccgcccgctggatgcgcgctcgaggttattcactgcggatttatcctggggtccagcagaaggacggctatctggccggtagcgacgaggtccgcctgaacgacctgcacgccgcttttgccgatgatgatgtcgataccatcctatgcctgcggggcggctatggcagcccacgcttgctcgaccggatcgattacgacctgctacgccgccatgccaagccgtttgtcggctacagcgacatcaccgcgttgcatctggccatcaatcgtcatgcgggtttcgtgacctttcatgggccgatgctcaatgccgacttgttgggtgacaaacagccacctaccgagtcctcgctgttcggcctgctacgggggcagttgaaggctggcagcctgctgccgcatccggcggcttatcccttgaccaccgtcgagcctggcatcgcctgcggtcagttgctgggcggcaacctgtcgttgatcgccgcgaccatgggcacgccatacgagatcaatggcgacggtatcattctgtttatcgaagacatcaacgagcctctgtaccggatcgaccgtctgctgacgcatctgcgtctggctggtaagctcgacaggcttcgcggggtgctggtgggagatgtggcgggcgtggagccccaggcgcttgccggactgctcaagcagaccttcgaacccctgtgcatcccggtgttggcgggatggcgcagtggccactgcgatccgaacctgaccctgccgatgggggcgatggtcaggctggatgcgggggagaagcagttgatcctggaacaggacgtggtattcggctgatcagcccgtgctcgctgcccttgtgggagcgagcttgctcaactatggcgcccctatgatccagcgcgcaggcctggctcagcgcgagcgcaggctctccagcagcttgtgggtcggatagccgtcggcgggccagcccagcgattgttgggcgctgcgaatcgccttgcgggtattggcgccgataatgccgtccgggttgccggcatcgtaattgttggcactgagcaggttctgcagctcgatgcgctcggagcggctgaggggcatgtcgtccttcggccagacgccgttgatcaggcccgaaccgttgaagcgttgggacagcaggttcaccgccagggcataggacgaggagttgttgtacttcagaacggcgcggaagttgtcgaggatcaggaatgccggcccgcgataacccgccggcaacagcaaggccgcggaaagttgttcggcttcggccggaacactggcgccgttgggcagctgcatgcccaggcgcaaccattcggctaccggtttgcggatcgcgccatccgccagcgcatagtcgaagccgttcgccagttgcacttcgaaaccccatggctggcccttctgccagccggagctttgcagatagtgcgcggtcgaggccagggcgtcggccgggctgttccagatgtcgcggcggccatcgccgtcgaagtccacggcgtgggtgttgtaggtggtcgggatgaactgggtctgccccatcgcgccggcccaggagccgagcatcttctcgggctggatgtcgccgtgctggagaatctgcagggcggccagcagctggctgttggcaaaggccggacggcgaccttcgtaggccagggttgcgagggagcggatgaccgatttgttgccctggaactcaccgaagttgctttccataccccagaccgccaccagggcctggcgatcgacgccataacgctgttcgatctgctgcaggatgtcggcgtactgattgagcagtgcctggcccttgcgtacgcgcagcggcgacagggcaccgtcgaggtattcccacaccggtcgggtgaattccggctggctgcggtcggccttgatcacgcccatgtcgggggtgataccggcgaatgcacggtcgaaaagatcggcacggatcccggcgttcagggcttcgacacgaaagcctgcctgccattgggcaaaggtctgggttggctggatgtccaggttgtcgacggccagcggagcgacggttgcaggcgcggcgagaggggcggcttgaatgctttggagtggctgggcatcggcggcggtgggtttttccgcgcaggcgacgagcagggcaaggctggaggcagcgatcagttggcgcaggtgccaacgacgggaaagacaaaagggcatgcacaggtccagagaatacgaatcagatacagaccttatcacgccggcggggttctccgctttatgcagccagaaagtaagaagcctcccagcttttagactggaaggcttcgcggcggtagctgcctttgcccttggcgggtcgttcctgacggctgcggaacagtggctgggcgatgatggatttggccttgttggggccatgcttggatggcttgctcattttgggttctcgcttgaggtgggtttgcgcggcagatgatcggccagcttgaccctgctgtccagccctgtgaagcgtagggtttttcagcaaacctcacggattcccccattccctgtaggaacgagccttgcttctgcaagacgttggggttactcggctgggagaggcaggcgttgccctgccatcaacagcgagaggcggctcaggctgctccagggcgaaccggcggcctgccccttgatctgcgcatcgatacgctgggcgtcgagcagcaattgcgcccagcgcggcgcggaatagcgctgcagggccttgctcatcagcggcttgcgtttgtcccagacgggcggacgggcctggctgaacactttgtccagcggagtgccctggctgtactgcagcgacatattggccagcgcccgcaattcccgggacagcgcccagagaatcaccggcggttcgacaccttcgccgcgcaggccttcgagcatgcgcagggcatgcgcggcctcgccattgaggatggcgtccaccagcccgaacacatcgaagcgcgcactgtcggcgactgccgcttgcacggtttccaccgtgatctggccaccctcggccatcagcttgagcttttcgatttcctgggccgcggccagcagattgccttctacccgggccgcaatgagttccacggcgtcctggctggcggaaagcccggcctgggacaggcgttggcgaatccactgcggcaactggttggcatccaccggccagatctggatgaactgggtctgctcgccatcgatcagggccttgccccatttggtcttttgcgcgctgccatcgagcttgggcaggctgatcagcagcagggtgtcttcggccggccgtgagcagtattcgatgaaggccgcggcgcctttgtcgccgggcttgcccgaaggcaggcgcagttccagcaagcgtttttcggcgaacaacgacatgctcgcgccggcttgcagcagcgttccccaatcgaaattggcgtcggcgctgaatacctggcgttcatcgaagccttgctggcgggcggcggtgcgaatggcgtcggcggcttcctggcacagcaacgggtcgtcgccactgatgacatagaccggtgcgagcgtgccttgcaggtgtttgccgagctgagcgggggcgagtttcataaggaggggcaagcggggcgcctgggcgccccacaagacttactggttcggcagctgcatgggcgactgttgcggggtttccgcctcagccttctgcgcggcttccagcgcctcggcctcggccttggcgcgggcatccgcggtctgctgcagttgatccagctgggtcggggtcagcagttgcaggcgcagcatcatgttctgcaccaggtcgcgacgcatttccttgcgcacttccagcgattcctggtcggaacccaccaggttgttgccgtcgtggatgtagaccttctgcacttgcagcttgtcgctgagcagggtcaggttgttctggccctggatctcgtagttcagcacggtggtcatttcatattcggctgaacgaccggcgccggcgtagctgaggctgcgctgggattcctgctcgcgggtcagcaccaacttgtagggcgcaccggcatagaccttgacgccactgctctgcaggacctggcgcagctgggtcacggtctcgccgtaagcgttacgggcgctcaggtcgagttccttgatcgccagttcggtggtgccggtaccgcgcagctgaaagccgcaggcgctcagcagtacggccaggcccatcaccaggaggttgcgtttgatcatcttgttgctccccttgaaaccatgtgggccgacagggcggccctggaggttttattcggcgtcagccatgggctgacgcctgatccaattagctagcgacgatattgaccagcttgccaggcacgacgatcactttacgaatcgtcaggccttcggtgaagcgcagcacgttctcgttgctccgggcggcggcttcgatctcttcacggctggcgctggccggcatttcgatctggccacgcagtttgccgttgacctggatgaccagcgtcaggctgtcctgcaccagcgcggtttcgtccaccgccggccagccggcgtcgatcaccgggtctgcgtgacccagttgattccacagctcgtggctgatgtgcggagtgatcggagccagcagcaacgtcacggcttccaggccttcgtgaaccagtgcgcgatcctgctcggtgccttgcgccgctttttccagcacgttcatcagtgtcatcacctgggcgatggcggtgttgaatttgtggttctggccgacgtcgtggctggcctgcttgatggccaggtggatcgagcggcgaatagctttctgctcgtcgttcaggctggcgacgtccagtttgcccggcaggccctgagtgacgtgggcttgagccagacgccagacgcgcttgaggaaacgatgcgaaccttccactccggagtcggaccattccgcgctcatgtcgggtggcgaggcgaacatcatgaacaggcggcaggtgtctgcgccgaactggtcaatcatcgactgtgggtcgacgccgttgttctttgacttggccatcttctcggtgccgccgatttccaccggcaagccatctgcgatcagtttggcgctaattactttggctttgctgtcgcgttcgagttcgacgtccgccgggttgaaccatgtataggcaccgttggcttcgcggcggtagtaggtctcggcgatcaccatgccttgggtcagcaggttcttgaacggctcgttggaactcaccaggccttcgtcgcgcatcagcttgtggaagaagcgcgcgtagagcaggtgcaggatcgcgtgttcgataccgccgatgtactggtccaccggcagccagtgattggccgcggccgggtcgaccaggccaccctcgtattttggcgaggcatagcgggcgtagtaccacgaggactcgacgaaggtgtccatggtgtcggtttcacgcttggcaggcttgccgcatttcgggcagctgcattcgtagaactcgggcatgcgcgccagtggcgaaccggcgccgtccggcaccacgtcttccggcagcaccacaggcaactggtcttgcgggaccggtacatcgccacagctgtcgcagtggatgatcgggatcgggcagccccagtagcgctggcggctgatgccccagtcgcgcaggcggaactgggtgcgggattggccgaggtttttcttcagcagggcgacttcgatggcatcgaaggcgccggcaaaatccagaccgttgaactcgccggagttgatcagttcgccgtgctcgccgtaggcgtcctgccaaggtgctggcgtttcgtcgccagcgctggtgcgcaccacgttcttgatcggcaggttgtacttggtggcgaattcgtagtcgcgctcgtcgtgtgccggaacggccatcaccgcgccatcgccgtagtgcatcagcacatagttggcgacccataccgggagtttttcaccggtcagcgggtgctcgacgaacagcgaagtcggcaggcctttcttctcttgagtggcgatgtcggcttcggcgacgctgccgcccttgcactcggcgataaaggcttgcagcgccgggtcgttctgcgccgccagggtggccagcgggtgctcggcggctaccgcgacgtaggtcgcgcccatcagggtgtcagggcgggtggtgaagactttcagtgcgcccgcttcgccaatggaggcctggtcgtaggggaattgcacttccatgccacgggatttgccgatccagttgcgttgcatggtcttgacctgctcgggccagcccggcagctcgtcgagactctccagcagctcatccgcgtaggcggtgatcttgaagtagtacatcgggatttcgcgtttttcgatcagcgcgccggaacgccagccgcgaccgtcgatcacctgttcgttggccaggacggtctggtcgaccgggtcccagttcacggtaccgttcttgcggtagatcacgcctttttcgaacaggcgagtgaacagccactgctcccagcgatagtagtccggcttgcaggtagtgacctcgcgggaccagtccaccgccaggcccaagctgcgcagctgggacttcatgtaggcgatgttttcgtaggtccacttggccggtgcgacgttgttcttcatcgcggcgttttccgctggcatgccgaaggcatcccaacccatgggttgcagcacgttcttgccttgcatgcgctggtagcgggagatcacgtcgccgatggtgtagttacgcacgtgccccatgtgtagcttgccgctggggtaagggaacatcgacaggcagtagtaagtttccttgcctggctgttcactgacttcaaaggacttttgctcatcccagaacgactgggcggcggcttcgatttcacggggctgatagtgttcgtgcatggctacttttgaactgaataggggtggcctaatcctcttcaatgcaacgttgggtggtgatggcgccagatatggcgttttcgctacccagtcgagctggaagtggagttacaggaagcgccgtagcatacatgaccgcgctctaccgagggaaaccctgattacgcgccgtgggccgttggtcgcggcaccctgccggtttcggcagtgcggctaagctcaaaaagggggagtgattcttactttcatgaggtgagtggatggttgagtcgcagcgaaaagttacaaaacccgagttgtacgaacgattgatagatcgtctggctttggccttggatacagcgaaaacagcagggagcttgcgtaatgagcgtcctgcggagttggagttgcggggcctgagtcacgccgagctcgaggtgatcaaagcctatctggatcgtagcgagcgtgagacgcaattgagcgtgctcgaatgcctgaggcacgaagtgactccacattcggccaaggtcatctggttgaaagacaaggtgcccgcccgggatgcggtaaaggtccgatccctgcagttcaagtgagtctgcgcagcccatgcgggcatctgcgcagcgtcaacgccgcgtaccttgtgcgtgaaatctgtttcatatctgttgttgctttgcttttacccacttaggcttcgagcatctttggagatgctcgatgccttttcgttatttcgtcaaacaactactcctgccgccaggccttctgttgctgctgcttctgctcgcctggtggtttcgccgctcgaggccgcgattggccggtgtgtgttttgccctcggcctgggcgggttctggttgatgagcctgcctgtgatggtggagtggggcgcgagtgccctggaaagtgagccggcgctgacgcaaagccagtggtcgaccctggccggacaggccgatgcgattgtggtgctgggttcgggccgtgaacgtggcgatccggcctggggttccgaccagccgaccggtgtcggcctggagcgccagcgctatgcggcgcgcctggccaaggcttccgggctgccgatcctgaccagcggtggcctgcactacggcacgccgcccacggaagcagcgctgatggccgagtcgttgctgaacgatttcgacgtaacggtgcgctggcaggaagggcgtagccgcacgacctgggaaaacgcccaattcaccgcgcaagtgctgaagccgcagggcgtcaagcgtgtggtgctggtcacccaggcctggcatatgcagcgggctgtctggagtttcgaacaggcaggattcaccgtggtgccggcacccgtggggttcctcggggtggataacgccaggccgctgggtggctggatgccggagttcaaatcgatctggcagagcggccagttgttgaacgaggcggtggggctggtgggctacaagctgttttatcgtggagaggactaggttcatctcgagccagtccgctcccacaggaatcgcaaatccccggcaggagcgagcaggctcgcgatgaagtcagacggtcttggcgatccggctggccagcagggcccagccgaacagcaggacgctcaggatgatcaggggccacgagcgccactgcaggtaaggcgtcaggttgtgcatcggcaccacttcgccatacagaatgccgcgttcgaactgcggaatctgcacggtgatcttgccgaacggatcgatcaggccggtcaccccgttgttggtggcgcggatcatccagcggccggcttccagggcacgcatctgggccatctgcaagtgctgcagcggaccgatcgaagtgccgaaccaggtgtcgttgctgatggtcagcagcaggtcgctgcgggctgacaggctggcggcgaattccgggtaaaccacctcgtagcagatgaacggtgcgatctggtaacccttggcttgcagcaaaggctggtcggcggggccgcgggcgaagtccgacatgggcaggtcgaagaacgcgatcaggccacgcagcaagtcctgcaggggcacgtactcaccgaagggcacgagcttctgcttgaggtactcgccatcgccttcgccaaccacggtaatgccgttgaagtagcgcttctggtggtgcacttcctggcggatcggtacaccggtgatcagcgccgaatgccggtcggcggcgaagttgcccatcatgttcagataaccttcggccgactccttgagcacgggcaccgcggtttccggccacaccagcagatccacgcgcttggaactgaagctcatgtcgcggtacagcgccagttgggagttgagttgcgcagggtcccatttcaggctctgttcgatattgccctggatcgccgccacggtcagcggctcgcccgacgggctggtccaggcatgtcccttgagcgcgatgccgatcacccagggggcgaccagcagcgccaggccggcggcgatggaccccttgcgtccggcgcggatcaagccgggcaggttgtagagcagggctgcggtcagcgccagggtaaaggagatcagccacatgccgcccagaggggccaagccggccagcgggccgtcgagttggctgtagccggaatagagccaggggaaacccgtcaggaaccagccgcggaaggcttcctggcccacccaaagggcggcgaaggccagggcatcggcgagaggggcttcattgcgccgcagccaacgcgcccagagccaggccggcagggcgaaaaagaaggcgatggcggcaatgaaggccagcatcagtaaacccgccagcagcaccgaggcgccgccgtaggtatggatgctgacgtagatccagctggtgcctgcggcaaacaggccgaagccgaaacaccagccgcgccacaacgcctggcgcgggcttagctcgcgcaggccggcgtaaaagaagccgaccgccagcagtgccaacggccagatgtcgtacggcgccagggccagggtggtgattgcgccagccgccatggccagcaggttaccgggccagccggggcgggttaagcgcagcatgtcgatccttagcgggggataggcgttagtcgcagcagatgaatccgacggctgtcggcattcaggatacggaagcgataggcgccgatttcggtgatttcgttacgtttaggcaggtgcccgaacgcgctcatcaccaggccgccgacggtgtcgaactcgtcgtcggagaactcgctgtcgaagaactcgttgaagttctcgatcggcgtcaacgccttgatcaggaaatcgccgcttggcaggggcttgatgtagctgtcttcctcgacgtcgtgctcgtcttcgatgtcgccgacgatctgctccagcacgtcctcgatggtcaccaggcctgccacgccgccgtattcgtcgatgacgatggccatgtgattgtggttggcgcggaactcacgcagcagcacgttcaggcgcttggattcgggaacgaaggtcgccggacgcagcagatccttgatgttgaagctgtcgccgttctccttgaggatcagcggcagcaggtccttggccagcaggacgcccatgacgtcgtcatggctttcgccgatcaccggataacgcgagtgcgcggaatcgaggacggacggcaggaattcgcggggagtctgggtcgccttgatgctgatcatctgcgagcgcggaaccatgatgtcccgtacctgcaggtcagcgacctggatggcgccttcgacgatggccagcgcttcgctgtccagcaacttgttctgatgggcttcgcgcagcagctccagcagctcctggcggtttttcggctcatgggcaaaagcctgggtcagtttacccagccacgacttttgcccgctgctcgatcggtcttcgctcatagcgattactctaaatccttggttgttacagatggatgttcttcggtttcgtcgtccgcataagggtcgggatgacccagttctgcaagcaacgttcgttccagtgcttccatttcctcggcttcgtcgtcatctatatggtcgtaacccaatagatgcaagcagccgtgaatcaccagatgggcccagtgggcctggaggtccttgccttgttcggcggcttcgcgctcgactacttcgacgcagatcaccaggtcgccgagcaatggaatgtccagcagttcgtccggcacatcggcggggaacgacaggacgttggtggcgtagtccttctgccgccaggtgcggttcagttcgcggccttcgggttcgtccaccaggcggatggtcagttccgagtcggccgtgcgctggcgcagggccagctcacaccattggcggaacagggcttcactgggagcaggcttgtcgcttgccagttgcagatcaagctcaagcatcgtggcgattgcctttttccgcggcggactgggcggactcgtcggccacgcgctgctcgaagcgctcgtaggcttcgacgatgcgttgcaccagcggatggcgcaccacgtccttgggcatgaagtgggtgaagctgattcccgggacgtccttgagaacgttgatcacatgagccaggccggacttggtgcccttgggcaggtcgacctgggtgatgtcgcccgtgatcacggcggtggagccgaagccgatccgggtcaggaacatcttcatctgctcgacggtggtgttctggctttcgtcgaggatgatgaaactgttgttcagcgtacggccgcgcatatacgccagcggcgcaatctcgatgacctggcgctcgatcagcttggccacgtgttcgaagccgagcatttcatacaacgcgtcatacaacgggcgcaggtacgggtcgatcttctgggccaggtcacccggcaggaagccgagtttctcaccggcttcgaccgccggacgcaccagcaggatgcgtcgtacctgctcgcgctccagtgcgtctaccgcacaggccacggccaggtaggtcttgccggtaccggccgggccgatgccgaagttgatgtcgttgccgaggatctccttgacgtagcgctgctgattcaagccgcgggggcgaatcatgccttttttggtgcgcagggccacggccgcttcggcgacagggtgattgtccagttcttcgacggcggattcctggaggaacaggtgcaccatgtccggcgacagctcggtacctttggtttcccggtacaggcggcgcaggaggttttccgcggaggtggtgtgcttgggttcgccgatcagttcgaactgattgccgcggttgcggatctcgatggtcaggcgctgctcgatcaagcgcaaatgctcgtcgaattgcccgcacagattggcgaagcggcgagcctcaaagggctcgaggatgaaacgatgtggttctatgggtgcgttcaaggtcgttttttagccgcccaacggcaataaaggatgaaatcaaggataacgccagaggcctgggtgcgaaagctcttatacaaagcaatgtctttcgccacattttccttggaggccggcttcccggcgatggcgtgcccgagaccactaccgctggtcagcccgcatcggcaggaggttattgcagcagcgatccgcgcagcgaatgaggctgggccgagtcgatgtgtacatcggcaaactggccgatcagcgtcgggttgtcgcagcggaaattgacgatgcggttgttctcggttcgcccctgcagttcgcccgggtctttcttcgaatagtcggtaaccaggatgcgctggatcgaaccgaccatttgtcggctgatttcgaatccttgctgattcagccgatgctgcagcgcgttcaggcgttcctttttcaactcttccggggtgtcgtccgccaggtcggctgccggggtgcccgggcgctggctgtagacgaacgagtaggagaagtcgaagccgacgtcttcgatcagcttcatggtctgttcgaagtctttttcggtctcgccggggaagccgacgatgaagtccgagctgatgcagatgcccggcacggcggcgcgcagtttgcgcagcttggatttgtattccagcgccgtatggttgcgcttcatggctgcgagaatccggtcggaacccgattgcaccggcaagtgcaggtgtttcaccagttccggcacgtcggcgtgggcctggatcaggctgtcggagaactccagcggatgggaggtggtatagcggatgcgctcgataccatcgaccgccgcgaccacgcggatcagttcggcgaggtcggccaggcggccgtcgtgggtctggccacggtagccgttgacgttctgccccagcagggtgacttcgcgtacgccgttttccgccaggtggatgatctcgcagatcacgtcgtcgaacggccggctgacttcctcgccacgggtgtaaggcaccacgcagaaggtgcagtacttgctgcagccttccatcactgagacataggcgctcgggccgtcgatgcgcggctctggcaggtggtcgaatttctcgatttccgggaacgagacgtcgacctgcggcagcttgctgctgcgggcggcatcgatcatttccggcaggcggtgcagggtctgcgggccgaagaccacgtcgacatagggcgcacgatcgcggatggccgcgccttcctggctggctacgcaaccgccgacggcgatgaccatgtccgggttggccagcttcagctcgcgccagcgacccagttgggaatacacccggtcctgggctcgttcgcggatcgagcaggtgttgagcaggatgacgtccgcgtcttcggcgcgggcggtgacttccagggcctggtgttcacccagcagatcgaccatgcgcgagctgtcgtactcgttcatctggcaaccgtgggtttctatgtagagcttcttggccatggacggagtcatcacgtgattcaaagaaccgcgcattatagggaacatggcctgaggttcctaccgctgcgcgtccggtggctatgctatagttcgcgccctcttttatatcccccgatgtgttacccgcccaccatgaccaaacgtgaagctccaatctacaaggtgattttcctcaaccagggacaggtgttcgaaatgtacgccaagcagatctatcaaagtgatctgtggggtttcctggaggtggaagagttcgtctttggcgagcgcacgcaagtggtcgtcgatccgagcgaagagaagctcaaggcccaattcgaaggcgtggtgcgcagctttgtgccgatgcattcgatcgtgcgcatcgacgaggtcgagcgcctgggtacgccgaagatcagcgaggcgcgtggcgtgagcaacgtcatgccgtttccgatgccgatgcctgagaagtaagggctgtatcgagtgtgctatcgcgagcaagcttgctcgcgatgtcatcaaggcaggggtgagaagggcgaacgcccgtcggcgctctgcaattccatcaggtatttgcggaaaatctgccccagcacctgggtggcgacttccagctcatcgcgctgcatgtgctcggccacttcgtcagccgtgtccagtgcctcttcggcaccgttgaccgccgccatcttcagcacgatataggcctgaacgttgttggccggtacgccttcgccgcgaaagaacatggtgccgagtttgaattgcgcctgggcgtggccttgcagcgaggccttttcaaagtagcttagggcctgattgagatcgcgcggggtatttttaccttcgtagtagaactcgcccaactcgtattgcgcttgcgcatccccttcgtcagccgccttctggcagaccgccagggcctcggacagatcctgtgactgagtattgagggtgcagcgacccatcgctgggatcaacaacgagttgccgcctgcttgtgcgtgcgcgagcaggggctgaaggagcaacaggcagcccagtgcaagggcgcggccggtgcggttcatgggaatcgacttacctctgaagggcgcgcggacccatcgagggatccaataagcgcgcattatgaaataagcagggccaaccttacaaagtctttactcgtttttctgctgcgcgggcgcgatatccgccgctttcgggactgtttcgggagtcggggcgcgaatgcagcgtaaaaccggcgccagcaagtgtggcgccggtttggcggggaaggttacttcagggcagcgaaagcgcgttcggccgcgtccagggtcagtttcagctcggcgtcgccgtgggcgatcgaggtgaagccggcttcgaaggcactcggggccaggtagacaccgccttcgagcatcaggtggaagaagcgtttgaacaggttggcatcgctggccatcacatcgtcgaacgtgacgatatcgtcggcgccgctgaaatacaggccgaacatgccgcccgcctgggtggtcacgaacgggatgccggcggcgtcagcacgttgctgcaggccgtcgagcaggcggctggtgtagtcgctcagctcggcgtggaagcccgggcggctgatcaggcgcagagtggtcaggccggcggccatggccagcgggttgcccgacagggtgccagcctggtagaccgggcccagcggcgcgatgtgttccatgatcttgcgtttgccgccgaagcagcccaccggcatgccgccgccgatgatcttgccgaaggtggacaggtccggggtcaccccgtagtgcgcctgggcaccgcccagggcgacgcggaaaccggtcatcacttcgtcgaagatcagcaccacgccgtacttgtcgcacaggctgcgcaagccttcgaggaagcccggggccggaggtacacagttcatgttgccggccaccggctcgacgatgatgcaggccacttcctggccgacttcggcgagcatcttctcgaccgcgtcgatgtcgttgaacggcagggtcagggtgtgtttggcgaaggccgccggtacgccggccgagctgggcacgccctgggtcagcgcgccggagccagccttgaccagcaggctgtcggagtggccgtggtagcagccttcgaacttgatgatgctgtcgcggccggtgaaaccacgggccaggcggatcgcgctcatggtcgcttcggtgccggagctgaccatgcgcaccatttccatggatggcacgatggagcagaccaggtcggccatttcggtttccatggcggtcggggcgccgtaggacagaccgtgttccagctgcttgcgcaccgcgtccagcacatccggatggctgtggccaaggatcatcggcccccaggaaccgacgtagtccacataacgcttgtcgtcttcgtcggtgacgtaggcgccttcggcgtgtttgaagaacagcggcgtgccgcccacgctcttgaacgcacgcacgggcgagttcacgccaccggggatgtgtttctgggcattggcaaacagggtttcggaacgagacatgatcggactctcggaaatcagcggttagaagagggcattgaaggcgcgggcacggcgggtcacttcctgggcgctgtcggcgccgaacaggccatggaccacggccagcaggtcgacgccatgggcgaccagcggcgcggcgttctccagggtgatgccgccgatcgcgcagatcggcaggtgcagccgggcgcgggcctggtccagcaactccaggttggccgtcggcgcgccgggcttggtgttggaattgaagaagcgcccgaaggcgacatagctggcgccttccttggcggcttgctcggccagctccagctgggcgtggcaggtcgagccgatgatcgcctggcggccaagcagggcacgggccggagtcagcgggccgtcggtctggcccaggtgtacgccgacgccgatgcgcgcggccaattcggcgtcgtcgttgatgatcagttgcgtcttgtagcgctcgcacaagctgtgcagggcttcggcttcgcgcaggcgacgggcctcgtcgctgctcttgtcgcggtattgcaggagggtcacgccaccgtcgagcgccgcctccacgtactgcaggaatttgccggccaacagttggctgtcggtaatggcatacagaccacgtagtttcatcgagcgagcctcatggcttacgagcagaagtccagcggcaggcggcgcggtacgaactggccttggcccagttgctcggcgtcgcgcagggtgcgccaggtgtaatcgagggccgacttcacggcgctggccaggttttcgccctgggccaggcgtccggccagggcgctggccagagtgcaaccggaaccgtgataactgcccggcagccgctggcaggtgtaggtgtgacggctgccgtcgcggctgtacaggcgattatgcacttcctgctcgtcgccatggccgccggtgatcagcaggtgtttgacgaatggcaggagcttttccgcgcattggtccgcagtgccttcgggcaactcggcgaggattcgtgcttccggaaggttcggggtggcgatggtcgccagtggcagcaggcgttcacgcatggcgtaaccgacctcgtccttgcccaggcgcccgccgccgccggcgcgcaataccgggtcgcagaccatcggcaggtgcggatgcgcctgcaacagctcgaccacggtgtcgaccatttccagcgagccgagcatgcccagcttgaccgcggcgaccgtggagtcgttgagtacggcgttggcctgggccagcacccactcgcgatccagcacacggaagtcgctgacgttgaccgtatcctgcacagtcagcgcagtcacagcaggagctgcatgacaaccctgggcgagcagggcttcgatatctgcctgcaggccggcgccgccactggggtcgtggccggagagacagaggacaacggggcgagagctgtagatattcatggtgcgcgagcttaccaccaaacgtcttttttgcacggcccccgcgtgttggccggggctggtttttccgccttcccggcaagttgaccgaggcaacagctctagatcaatggatagcgctgaaacgcccgttctagagcctttaaactaaagtttttggtggtgttcattggccatcaacggctatgctagagtggatccaaaccaataacaggtaatgccggttttacgtctactcaaagggaaatggggggcttcctgacataaccggacaagccacgctggggctttatgcgctatttgctgatgttgctgttgagcttgccgatgctggctggcgcggtcgagttcgacgagttcacccaaagcctgcccttgggtcgggtgatgcaggtgtttgaagacgcgagtggtcaggcaacgatcgcggatgtcagcgcagcggcgatggccggcagtttcaagacccatgacaaggccaccctcaacgccggttactcccgctcggcattctggctgaagatcgacctcggctaccgtcctgccaacccctccatacgacacacctggctgctggagctggcctatccgccgctcgatcatctggagctgtatgtgcccgatgaaaccggtggctaccgtctggcccagcgcaccggcgatgccttgccgttcgacagccggcagatccgccagaacaattacctgttcgacctgagttttgcgccctacgagcaaaagaccctgttcctgcgcctgcagagccagggctcggtccaggcgccggtgacgctctggtccagcacggcgtacctggaagcgcagccggtgcgcctgtatgtactcggcctgatctacggcgtgctgctggggatgctggtctacaacctgttcatttacctgagcgtgcgcgacaccagttacctctattacatcctctacatcgcctcgttcgggctgtaccaactgtcggtgaacggcgccgcggtggagtacttctggccggacaacccgtggtgggccaacgcggcgacgccattcttcattggcgcggcggccctgttcggcagtcagttcgcccgcagtttcctgcagaccgccagccacagccgctgggtcgatcgcctgctgctggtgctgatcctgtgcagcattgtggtggtggccctgtcgttgatgaccagctacgccctggcgttgcgtctggccacggccctggcgctgatctttaccgtggtgatcttcgtctccggcatcgtcgcctggtgccgcggcatgcgcgtggcgcgttacttcatcatcgcctggtcggcgttcctggtgggcgggatcatcaataccctgatggtgctgggttatctgccgaacatgttcctgaccatgtattccagccagatcggttcggccatcgaggtggcgctgttgtcgctggccctggccgaccgcatcaactcgatgcgcgagcagcaggcgcagaccctgttcgatgccgggcagaagctcgaagtgctcaaccagcagctggcccacagcaaccggctcaaggatgagtttctcgccactctgacccacgagctgcgcacgccgatgaatggggtgatcggttccctggagctgatgcagaccgtcgatctcgatccggagctggagcaataccagcagactgccgccggttcggcccgggacatgatgcgcatggtcaatggcatcctgaccttgaccgagctgcaggccggcaagctcagtgcccagcacgagagcttcagcctgcgttcgctgctcgatgctttgctgggccagttttgtgccaacgcctcggccaaggggctgggcttcgatgtcgacctggccgccgggctgcccgatcggctgctgggcgatcgcggcaagttgagccagtgcctcgagtgcctgctggacaatgccatcaagttcacccgggtgggtggcctggtcctgcgagtgactggcaagccggtggcaaccgggcgggtggcgctgaccttcgcggtgatcgacaccggcatcggtttcgtcaatctcgatgaggcctcgttgtaccagcgcttcttccagctcgatggttcgatgacccgtgaatacggcgggctgggcgtggggctggcgatctgtcggcaactggtggatctgctgggtggccatctgacccatgaatcggagccggggcgtggcagctgtttccgcctggaggtgaccttcgaggtggacggcgagcagccgatggcggcccagccagcgctgcgtgtccgcgccgtccggcgcaggccgcaggattgcagcgtgctgctggtggacgacaacagcatcaatcaactggtgatccgcggcatgttgctcaagctgggttatcaggtacgcacggcggagaacgctcgcggggcgctggcgttgttgcgccgggagtcggtggatgcggtgctgctcgattgccagatcgagcaggccgaggcgctcaagctgtgcgatcaggtgcgcggcatgccgggttgcgccgacttaccggtgctgctggtatcggcctcggcgcacgctgtggaggctgagcgctgcctgctcgattacctctcccggccggtgaaattcgaggagttgcaagctgttctggcgcgtcgggtgctggcctcggaacagggcgaaagcgccggcatttaggcgggtatgccactttgttcggtggggagggggtgcttaactgaggttctggcacacccctcaaggagccccgacatgaacctgcaccagttcgccgagacccacgaagtcaccaaccagccaccttccctggacggtaccaacctctatcgaatcgatctgccgttgcaggagtgggcacggcgtttcggcgctggttgggccgaagcgcggatcgacgcctacggtgccctggccggtgggccgctgatggaggcggggttcctggccaaccagaacaagccggtgttcaccagccatgaccgttacgggcatcgcctcgatctggtggagtttcatccggcgtatcacgagctgatgcgtaccgccatcgagcacggcctgacgtccttgccctgggctcatccgcaatccggggcgcatgtcgcgcgcgccgccatgacttatctgcacagccaggccgaggccggcagcggttgcccgctgaccatgaccttcgcctgtgtgccggcgttgaagctgcagccggatctcgccgaacaatggctgccgaaagtcctcgccaccgaatatgacccacgcaatgtcggcatggcccacaaggccggtgtcaccatcggcatggcgatgaccgagaaacaaggcggtaccgatgtgcgcgccaacaccaccaaggcgtatccggtgggcgctacggggccggggcaggcttatgagctggtgggccacaaatggttctgttcggcgccgatgtgcgacgccttcctgaccctggcccagaccgaaaaaggcctgacctgcttcctgttgcctcgccatcgtccggatgacagccgcaaccagttctatatccagcgcctgaaaaacaagctcggcaattgctccaatgcctccagcgaagtggagttccgcggggccctggcgtggatgatcggtgaagaagggcgcggtgtgccgaccatcatcgagatggtggccatgacccgcttcgattgcatggtcggctccagctcgctgatgcgccaggccctgacccaggccgcccatcattgtgcccatcggctggtgggcgggcgtgtgctcagcgagcaacccttgatgcagaacgtgctggccgacctggcgctggaaagcgaggcggcgctggccttgagcctgcgcatgggccgcgcgctggataacctggatgacccgcaagaagccatgttctcgcgactggtgacggcggtgggcaaatactggatctgcaagcgggccccggcaatgatcaacgaggccgccgagtgcatgggcggcgccggttatgtcgaggagagcattctgccgcggctgtaccgcgaagcaccggtcaactcgacctgggaaggttccggcaacgtgcagtgcctggatgtgctgcgcgccttgtccaaggagccgggcgtgctcgatgtgttgttcgccgagctgggcgatggccatggcgacaggcgcctggccgcgcatatcgccaacctgaaaggcgccttccaggacaccgacgacattcagtaccgcgcccgccagctgaccgaggacatcgccctgggcctgcaggccaagctgttgctggaagccggcaacgcggtggtcagcgatgcctttatcgccagtcgcctgggttccgcaggaagggtctacggcaccttgccgcgaggcctggatgtggaagcgatagtcgcgcgctcgaccccggcaggcttctgatcgatctgtaggcgagagggcgcgcccggttcttgttcgcgctggggatcgcgagcaagaacctgacggcccgggcgattccgctgttcccgtgagacggcgttgcaggcaagatgaaggcctgcaagatcagaacacaggatgcttaccgtgaccgaagcttttattgtcgttcaaaccgccgagcaagccgtggaccggcttgccgctttgcatgagcgggccaccacgtcgctgagccaggcgctcaagcgttacctcaaggatcgtgtcgaaccggacgccgaacagcgcgccctgtttcgttacccggaattacgcctgacctatctctgccagggcgaagtcccgcagaccacccgcgcctacgccaaggtccagttgccgggcacctacagcgtcacggtcacccatcccgccgccttccgtaagtacctgctggaacagctggtgcccctgatgcacgacttcaccgtgaccgtggaagtgggcgtcagcgagcagaacatcccgtatccgtacgtggtcgagcagggcgatgaactggccggttccggcgtcaccgccgcggtgctggcgcgggtgttccccagcaccgacctgtccgccgccaccgatggcatcgccgacgggctgtacgattgggagaacaccaatccgctgcccctggcgctgttcgatgccgcgcgggtggatttctccctgcgccgcctggtgcactacaccggcagcgactggcgccatgtgcagccgtggatcctgctgaccaactaccaccgctatgtcgaccagttcatcacccacggtcttgaacagctgcgcagcgatccgcggttcgtgcgcatggtcctgccgggcaatgtgatcatcgagaagggcatggatcacggcgaagcctcgtcgatcgccgccggggtggtctggcaccgctaccagatgccggcttatcacctgctggccagcgacggccacggcgtgaccctggtgaacatcggcgtcggcccgtccaacgccaagaacatcactgaccatttggcggtattgcgtccgcactgctggctgatgatcggccactgcggcggcctgcggcagtcgcagaccatcggtgactatgtgctggctcacgcctacatgcgtcgcgacggcattctcgatcgcgtggtgccgccgaacattccgattccggccctggccgaagtacagctggcgttgcagcaggccgccgccaacgtcaccggcgagaagggcgacgacctgaaaaaacgcctgcgcaccggcaccgtgctgacctacgacgaccgtaactgggagttgcgttgggcccaggagcgtccgctgatcaacctgtcccgcgccgtggcggtggacatggaaagtggcaccatcgccgcccaggggtatcgcctgcgggtgccgtacggcactttgctgtgtgtctcggacaagccgctgcacagtgaaatcaagctgccgggttcggccaacgccttttatgagcgcgcggtcagccagcacctgaagatcggtatcgccgcggtggacctgctgcgtaccgagctcaattcgctgcactcgcgcaagctgcgcagcttcgacgagccgccgttccgctgatcgcgggatggtcatttaacggtcgggccactagcatggtcggccctgaccgttagatgttcttttcgccatgtctcgtcctcctcgtcccgcttcccgccgccctggcgtgaagagtccttcatcgtcttccgcgccgcgccgtgttgccaaggcgccaccggccgagccgaagctgatcctgttcaacaaacccttcgatgtgctgacccagttcagcgacggcgaagggcgggcgaccctcaaggacttcatcgcgatccccggtatctacccggccgggcgcctggaccgcgacagcgaaggcttgctgctgctgaccaacgacggccagttgcaggcgcgcatcgccgaccccaggcacaagttggccaagacctattgggtgcaggtggagggggagcccacggccgagcaattgcagcgtctgcgtgatggcgtggagttgaatgacggcatgaccctgccggccgaagcccggcagctggaagagccgcaactgtggccgcgcaacccgccggtgcgctttcgcaagagcgtgcccaccagttggctggaattgatcattcgtgaagggcgcaatcgccaggtgcggcgcatgaccgccgccgtggggttgccgacattgcgcctggtgcgggtcaggatcggcgactggacgatcgaagggcttgaccagggccagtggaaggaggttccggcgcgcttataaggcgccggattcgatcaggccgatcaccacgctcttgataatgaacgcggccacgcccaggcccaggacgaagaacaggatgaaggagccgaagcgtccggccttggacttcttcgccagatcccagacgatgaaggccatgaaaatgatcaggatggtcaccagaccggtcatcatccactcttcgaatactgcaggatccatcgaacatctccagcgcgggcaaggctaaaaggcgggggcgagtatacgccaaggggccgcgaccgggcattgatccaggtgcgcttcgtcgtcacaggctctgcatgtccttgtaggagcgagcttgctcgcgataaatatcccaggccatacatcggttacggccggacatttctatcgcgagcaagctcgctcctacagaagagatagcgctcagttgcgcaggtgagtcagcggcagttcggtgctgttgagcacctggttgagcacgaagctggagcgtacgctggtcacgccttcgatgcgggtcagatggccgagcagcagtttctggtagtgatccatgtccggcaccaccaccttgagctggtagtcggcgtccatcccggtcaccaggctgcattcgaggacctgcggcaggctgcggatcgccgcctcgaagttctcgaaacgctcgggggtgtggcggtccatgccgatcagcacgtaggcggtcaggctcaggccgagcatcttgcggtccagcagggcgacctggcgggaaatgtagccgtcgtcttccagttgcttgacccgacgcgaacacggcgaaggcgacaggccgatacgttcggccagttcctgattggagatgcgggcgtcgcgctgcaattccgccaaaatgctgaggtcgtatcggtcgagtttgctcataggacaggcctttttaataactattgcgcgatattatctatcctgggttaaaaattgcgcaagtcatgtttattagagcaatcttcgcaatcctctgtcggcgcgccaggcctattcttatcaccagaatcactgcccggacatagagtccactgcggcccgccgaatcaggcctgccgcggccgccaatcccacagggttgagccggcccccgggctacacactgtccagaagacggcgtgaggtgagccggcgccataagcgtcgagcacggacgaaattctcaaagggggaccgacgggtcccccttttttattgcctgcgcgccaggaaatatcccgtggcgcctcaataaataagtgttgcgactgataacctgtggcagaaccggcctgggcttttccagtcttatctacaggcccccatccgtagtgaggaatagcatgaaatcgcgcatctggcgtttggcaggtgttggtttgctctgtgtgagcgtcagtgcgcaggggcttgccgatgaccgcaatgacggccgtggctggtccaatggcggccagcgcagtgacgacgggtatccgggaaacggccaggggcgaggcgaaagccatcagtcgcgccagcagactgaaatcattcgtggcgacaacagccagcagttcgagcgcaacgtcgagaacgggcgttggcagaaccacgggccgaatgatcaagggcgggaacgacaggcacagccgtccgccaacctgccgatccagggtcgccccgataccgtccgccagacccaggaaccgcgccagggttattaccaggacatcccgcgccgcaacgactacaacccgcattggcaggccggcggagggggttcgcgtccctacgactatcgctggccgggccgtccggagggacggggcaacggctgggggccgggcccgcaatatcggccgggttatgtgatcgatcgttttccggaccggcattaccgtgtgccttatcgcggccgggactattacttctccggtggctattggtatcgcccagaggggccgcgttacgttgtggtgcgcccaccctacgggattcgcgtggcctacctgccggactacgcgcgcgaggtgtggatcggcagcgcgctgttcttcctggccgcgggtgcctactacatctacgaggccagtacccagcagtacgtagtggtcgagccgccggtggccagcccgccgccgcaggccggcaatgattacaacgtgctggcctacccggtcagtgggcagagcccgcagcagatcaatcaggaccgctacgactgttatcgctgggcggtgcagcagagcggcttcgacccggcggcgatgacctatcccccggcgccgcaggtggtccagacctaccgccaggcccagggcggttgcctgagctcgcgcggctatcaggtgacttactgagcccgagcggcgagcaccgcttcctgcgggtcggcgtgcaccagcacctcggcccgcggataggccgcatgaatcgcctcggcggcctgatcgctgatgccgtgggccaccgacagggtcagttcccccggtaattccagatgcagttgcacgaaccagtggttgccggaaatccgcgtgcgcagatcatgggcgccgagtaccccgggcacggcgcataccagttccagcatgtgctggctgacctcgggcggcagttcctcgtccatcagcaccgccacgctttcccgagcgatctggatcgcgctccacaggatgtagacggcaatcgccaggccgaaccaggcgtccagttgctgccagccgaaactggccagcaccagcgccagcaggatgctgccattgagcagcaggtcggagcgatagtgcagcgaatcggcgcgtaccgcggtggagccggtttcgcggatcacccggtattgcaccatcagcagcgccacggtcagcgccagcgacaacagcatcacgccgataccgatccagggcgcgcccaacggttcggggttctgcaggcgttcgacggcctgtaccccgatcagcaccgcgctcaccgcgatgaacagcgcctgggccatgcccgacagcgattcggccttgccgtggccgtagcggtggtcttcgtcggccgggcgcagggcgtaatgcacggccagcaggttgaggaacgacgcggcgccatcgagcagcgagtcggtgaggccggccagcaggctgaccgagccgctcagccaccaggcgatggccttggccacgatcaggatactggccaccgccagcgaggcgcgggtggccaggcgcaacaggcgtgcgtgttccgggctactgctcatacaaggcttgttccttcaagaagcgcgagggagaccgtacagggccagctgttgcgcgctgcccttgtgctggatcagacgtggatcgtccagagggaagctgcggcccagctcgctttcgaggatagcctgcaacttgtggttatcgacctggccgtcggcgcctatggcttgctgcagcttgtgcgggtcgacctgcgcggtcttgcccggttccaggtagatggcgccggtggcgaagtcgacgccaaaggcgatcagccccgggatcacataaaacagcaggcccacggcgtcgagcacggctaccagcgggtcgatcttgccgtcgatctggccgcgtcggtcggggaagaagatcgagccgcaggcggtgagctgagtcagcagggtggcaaccaggacgccaccgatgatgcggaaaggaatacgcatgtaaatctcctgaacagacacgaaagagcaaggctgaagcgttgccggtatgaattcagaccgtgattaacgccaggcagttcgccgttatactcgcgcctctgtttgggagccagtatgaattctttgccaattgatgaagttttacctgccctgcgtgaagccctggcgacacgccacgaggccgtgctcgaagcaccgcccggcgccggtaagaccacccgtgtgcctttggccctgttgaacgaaccctggctggccggacaacgtattctcatgctcgaaccgcggcgcctggcggcgcgggcggcggccgaacgtctggccagcgaattgggggaaaaggtcggcgaaaccgtgggctaccgtatccgtctggatagcaaggtcggcccgaacacccgcatcgaggtggttaccgaggggatcctgacccgccgcctgcaggacgatccggcgctggaaggcgtcggcctgctgatcttcgacgaattccacgagcgcagtctcgacgccgacctggccctggccttgagcctcaatggccgcgatctgtttcgcgacgagcagccgctgaaaatcctcctgatgtcggcgaccctggaaggcgagcgcttggccgggctgctggacgacgcgccgatcctgcgcagcgaaggccgcatgttcccggtcgatgtgcgctgggggcggcccttccagccgggcgagttcatcgagccccggctggtgcagaccgttcttgaagcgctgaacgatgaaagcggcagcgtcctggtgttcctgccggggcaggccgagatccgtcgggtgcatcagcagttggccgacgccctgggcgagcgcccggagattctgctttgtccgctgcacggtgaactggacctggcggcgcagcgcgcggccatcgagccggctccgcccggcaaacgcaaagtggtgctggcgaccaatatcgccgagaccagcctgaccatcgacggcgtgcgcgtggtggtcgatgccgggctggcgcgggtgccgcgtttcgacccgggcagcggcatgacccgtctcgacacccagcgtatttcccgggccagcgccacccagcgcgccggtcgggccgggcgcctggagccgggcgtgtgctatcgcctgtggtcccaggaccagcatgaacaactggcggcctatggcagcgcggagattctccaggcggacctggcgggcctggccctgcaactggcccgctggggtgtgacaccggcgcagttggtgtggctggatgtgccgcccggcgcggcctatgcccaggcccaggacttgctcgaacgcctcggagcgctgacggccaaggctggcgaggactgcaagctgacacctcatggccaggcaatggccgagttgccggcccatccgcgcattgcccatctgctgttgcggggccaggccctggggctggcgaacatggcctgcgacgtcgccgccttgctcggcgagcgcgacatcctgcgtggcggcggtgccgacctgcatagccgcctggtgctgctgtccggtgaagagcgcgcggcccgtggcgcccagggcggggtccagcgggctcggcaactggcccggcaataccgtggttatctgcgcggccagccaagccaggcggtggcggacccggatcacccgcgctggctgggcgccttgctggcgctggcctatccggatcgggtcgcccagcaacgtcgccccggcggcgccgaataccggctggccaacggccgcgcggcgctgttcagcgagaccgacagcctgatgaagcagccctggctggtgatcgccgacctgggcagtcgccaggggcagcgggaagagcgcatctacctggcggcggatttcgacccggcgctgttcgactcggtcctggccgagcaggtgcgctgcgtcgatcagcttgactgggacgagcgcgaagggctgttgcgcgccgagcgccagcgcaaggtcggcgaactggtgctcagccgcgagccgctggccggcctggacgaggcggcgcgctgccaggccctggtcaacctggtgcggcgcaagggcctggagctgttgccctggaccccggagctgcgccagtggcaggcccgggtggctttgttgcgccagctcgatctagaggccaagggcgaaagccagtggccggacgttagtgacgcggcgctgctcaagagcctggaaagctggctgctgccgtacctgggcaaggtttcgcgcctcagccattttgccaacctggaactggccagcattgtccacagcctgctgccctggccgttgccgcagcgcctggacgagctggcgccgcaccacctgacggtgccgtccggctcgtcgatccgccttgattacagtgaacaaccgccgattcttgcggtgcgcctgcaggagttgttcggcctggcagagacaccacggatcgctggcggccggcaggtggtcaagctgcacctgctgtccccggcgcggcggccggtgcaggtcacccaggacctggcaaacttctggcgcagcacctacgccgaggtgaagaaggacctcaagggccgatacccgaaacactactggccggacgacccgctggtggccgaagccacggcccgcgccaagccgcgcaagtaaccagtgtgtagccgctgccgaaggctgcgatcgagcgcgtagcgctcgccatccggttcatgtcaggacgcggactcaggttttgcgtccgctgcgtcggaatgccgcccaagccgatcgcagcctgcggcagcggctacaggtgttggtcgaaaagtgagcagtgggctggagagcttgtattgcctggcgtgcagcggcttacgcgcaggttatccacaagcggctccacagcggttgggggtaaggcgcccactttttgatgacaacctgatgacgccacaggccccgtttccgtagccgctgccgcaggctgcgataggtccgcaggacctccagcgccagtgccgacgccagcgaccgttccggccttatcgcagtctgccgcagcggctacaacgcgacgggcagcaggaagcgggcgatcagtggcaggtggtcggagatgcgcagggtatcgtcctgccgtacctgggcctcgacccgcttgagccgggggctgtggaacaggtagtcgacggtgcgatccgggccgctcagggccgggtcattggggtagtgggtcagccacagggcgcggtcgatgccgctggcctcgttgttggtgggaatcatcgggtacttgtcccagagcgtgtgcaacgcgctgtcggcggagtagggcgtgcgttgctcgggggcgagacgctggtactggcccaggggcagcaggttgaagtcgccgccgatcagccagggcgtgccacgggcttcgaagcggtcgaggatcctggtgaccgcgttcacctgggcttgcagggtgtcgtcgggtttcctcgcgcggtccagatgggtattgagcaccgccatctgcccgccgtcgcttaacggcaggtaactcaccagcacggcatttttcggctggaactggcggctaaggagattggcctcgggcaccggcaattgcaggcgttcggcgtgttcgatgcggtagcggctcaaggtcgccagttgccggccgacgctgccgaagatgtgcggggagggtacgaagtcggccttccagtcgaaggcctgtgtgctgcacggatacaggtcggtcaggcgttcctgcagcagcttgagctggtcctggtagccgctggccttggcgccgttgtccagttcctgcagcagcacgatgtccggctgttcatcgcgaatcacccgggccacttcgtccaggctgaaggccatgtcttccggggtcgggcgctcgtccggcccctgggcctggtcgttccagaacacgtagcgcttgcctgccaggtactgcacgttccaggtcatcaccttcagcgcctggcccggcaccaggctgggcaccttgcccgtgcaggcgaccggcagcgactccttggcgtcggggcgccaggtcaggctgtagaccagggctgacaacaggcctgcgctgatcagcaggcccaggaggatgaagcgaaatagacggggcatcggctcggcttatggcgttgctggattgagcccgagcataaccgagagcgggaccgcggcccaaggggtagagcggtcggcccccggggtcactgctggtcaggcgagtcgccgatcagcatgaacaggcggaataccaccacgctggtgaacaactgcaggaagctgtgggcgctttcgatcagcagcgacagcatcggacccggctcggggtacgccgccaggctggcgcccttgagcacccacagcggggccatcacggccaggatgcagaccaggatccgcaggaagtgcccgcgggtcaggcggaagctttccttgatcgcggccagcggttgcaggcccttgagcaccagcaggtattcggcgaaggccagggtcaccatcagccacagcccgggcaggaaatacagcgacaggcccagcaggatcagcagggtgttgatggcggtcagcaaggcaaagcgcggccacaggctgacggtcgcggcgagcaggtcgcgggccaatggcgattcgccacggctgcgggcatcgagaaacaggatcagtaccccggtgtagagcgggtagatcaacaggccgacgatcacgctgtagccgggaaaggcctcggggcccagcgagctgtcgaccgcctgttgcagcagcgcttcgaggaccaccagcggcaggcacagttggacgatacggcccaggttgcgctggcagaagtacagggagtcgcgcagaacggttaacggattcatcagtggttatcgcagatcacaaaaagcggttggacactttaaccgatgcagccccggggcgagcaaacgtaaacgttaggtaaaggccattgaaagctcgccgggcagccccattactggttgcaccttgtgcatgacgacaaggccccgttttttaccggcaatctaaagaggtcgccatgaacagcgaagagcaaaccctgatcgatggactgttttcacggttgcagcaagccgagaaggattcagccccgcgcgacgtccaggccgaggcgcggatcaaggagcatctgacccggcagcctgccgccgggtatttcatgacccaggcgattctggtgcaagaggcggcaatcaagagcctcgacgagcagaacaagcaactcacccagcaagtccagcaactgcaggccgagttgcagcaggccagatcccaggccgcggcgccggcgcccagcagcggtggcggcttcctttcgagcatcttcggtagcggttcccgcgatccgcagccggcgccgacgcaaagcgctccggcctcgtccggcggtggctggcgcgaaccggcgcggccggcgttcaacccgcagccgcagcagaactacccgcaacagagctatccccagcagaactacgccgcgccaccccagcaggctccggccgcggctggcagcagcttcctcggcggcgcgctgaaaaccgccgccggcgtggcaggtggcgtgatgctggcgcaaggcctcagcagcctgttccacggcaaccagcagccgcaggaaatcgtcgaagtgatcaaggaagaaccggcgcccgccagcgacaacgcgggtggctggggcaatgacgagcagcgtatggccaataacgactcctggggcaacaacgaccagggtggtttcagcgatgccgactacggcaacgacgacagctcgttcttttccgacgacgattccttcgtctgatccgccatcggtccggaacgcaacagcgtcccggaccgattattcgcggaaccttccttctggctggcatactgggcgacttttcagggtttgagtcccggcccagttcgcgcgcgtgagcgccatgaggataagcggtgaaaaaaatcgctgtgttcgccgatgtccagaatctctattacaccgtgcgccaggcctatggctgccacttcaactatgccgccctgtgggccgatatcagccagcaggggcagatagtcgaggcctacgcctatgcgatcgaccggggcgacagcaagcagcagcagttccagcagatcctgcgcaacctgggcttcacggtaaaactcaaaccctatatccagcgcagcgacggctcggccaagggcgactgggacgtgggtatcaccatcgacatcatggacgccgcggcccatgtcgacgaagtggtgctggcctccggcgacggcgatttcgacctgttgctcgagcgcatcatcagcaagcatggcgtcgaagcggtggcctatggcgtgccggggctgaccgccaattcgctgattcgcgcggccacgcgctacgtgccgatcgaaggcgcgctactgctcaaaaactgagctgactgttttttgtacggagctggacaggtttggaacgcatcgcagtcatcgactttgaaaccaccgggatctccccgagcagcagttgccgggccacggaaatcgccgtggtgatccttgagcaggggcgcatcgtcgagcgttaccagagcctgatgaacgccggcgtgcgggtgccggccttcatcgaacaactgaccggcatcagcaacgccatgctgcgcggcgcgccgccggccgagcaggtgatgaacgaggtcaacgagttcgtcggcaccacgccgctgctggcgcacaacgctgcgttcgaccaaaagttctgggactacgaactcggccggatcaagcgcacccgcttgcagaacttcgcctgttccctgttgctggcccgacggctgatgccggcggcgcccaaccacaagctcggcaccctcaccacgttcgccagcctgccccataccggccaggctcaccgggccatggccgatgcggaaatggccgccaacctcaccgcccacctggcgctggagctgcgacagaaacacgggctgcgcgagctgtcccacgatttcctgtgcaaattgcagaaagtgccggccgccaagatcggcgaacacctcaagcgccatcgcggcgcctgactcctgtagccgctgccgcaggctgcgataaggctcgaagagccttccgaggccctcaagagcgcgtctccttcggagccgatcgcagcctgcggcagcggctacagtcggtgctggccgggttcacttgccgttgctctccagatgccccagcggcacgcgctgttcgatggcgctggagagtacgatcgaggtcttgctgaacccgtacttcgccacccggttgatcagctcttccagctccggcatcgagccgacggcggcgcgcatgatcacgcacggatcgccggtgacccgctggcattcggtgagttgcgggatccggctcagttcgtcgtaggccttctgattgccgtgctgggccatgcgcagttcgatcacgcactggatcggcagcccgagcttggccaggtcgaccttggcctggtaaccggtgatcactccgctggcttcaagtttggccacccgttcggccacggcgggggcggagaggttcaccttgcgcgccagctccgcgtagctcgcccggccattttccagcagggcggcgaggagcatgcggtcatatttatccatgataaggctcccaaactcagcgactttcgaaagcatggtttatagccagaatctccatgttttgaaaagtgtaccgatgctttaaacaggttttgtaacttaagttccgccggccggctttctagaataaccctctccctcgtcctgtcttcgagcttcccatgcctggcctacgccgttttcccttgcccctgattgccgccttttttgcgttgtacgtgatctgggggtcgacctacctggtgatccgtatcggtgtcgaatactggccgccgctgatgctcgccggcatccgtttcgtgatcgccggcagcctgatgtacggcttcctgcgttggcgcggggcgccggcgccgacctgggcgcaatggcgggcggcgggggtgatcggcatcctgctgttgagctgcggtaatggcgcggtcactgtcgccgaacacatgggcgtggcgtccggagtggcggccctggcggtggccacggtgccgctgttcaccctgctgtgcggttacttctggggcgcgcgcaacactcgcctggaatgggccgggatcgtcctcgggctgatcggcatcgccatgctcaacctcggctccaacctgcagtcgagcccgaccggggcggccttgctggtgttcgcggcggcggcctgggccttcggttcggtgtggagcaagcacctgccgttgccgcaaggggcgatggccagcgccgtcgagatgctggtgggcggcgtggtgctgctgatcggtagctggttgagcggcgagcaactggccgccgttccgccgatcgaaggctgggcagccctggcgtacctgatcggtttcggctcgatcatcgccttcaacgcctacatgtacttgctcaagcatgtgcgtccggcggcggccaccagctatgcctacgtcaacccggcggtagcggtgctgctggggatcgtgtttgtcggtgagactatcggcctggaggaggcgctggcgatggtggtgatcatcagtgccgtggtgttgatcggcctgccgcagtggagccgaccgaaagtgaaagtgctggcggaagaaacgaccgcctgacactggcggtcgtgattgcctgaccccccggccgcgcgcgctgcgttcgcccgggggggcagttacaggggtatcagttacaggcgccttcgtcgcgccagaccttgccgctgccttcgcctccggtatacgccgggttacccggttcattgccctgggtccaccagcgcgcggtatagaagtggccgttgtggctgaccttgttgccggccaggtacgcgttattcgcgttccattgccccaggcagaggctgggttgcccaccatcctcggcgctgaccttcacgttgtgctcgctgaccactgtgtgatggccgttgctcagttcgaggctgaagcggtagttggcgtccttgccggtcttcggcgcgatgaacgtcagttgcggcccgttggcctggaaactcaggctcggggtgacgctccaacggtactccaggggcaggcccgcggggtcgctggagcccgaggcgtcgagccggacctgctcgccggccttggcttgggtcgcaccgttgatgctcggtaggggtggctcgacctgagtgtcgttgtcgcatggccccagatccttccacaccttgccgctgccgtcggcgccggtgaagttcggattgccgggttcgctgccctgtacccaccagcgggccatgtattggcgacccttgtgctgcacctggtttttttccgtatagaccttgccggcttcccactgggcttggcagctggccgcgttgccgccggccttgaccagcacttcatggctggcgctgctgctctgcttgccgttgctcagcttcaacgtgaagcggtagcgggtgtcgctggcccgttcgggcgcgctgaagctcaggcgcgggccgtcgaagctgaagtccagggccggcgtcacttcccaggcgtaactcagggcattgccctgcgggtcgctggacgcggaggcatccaggaccacctgctgaccggcctcggcctcggtcttgccattgatcaccgccaccggcggcaggtcggcgtcgaccggcttgagggcggcggacttgacctcgttgtcggcgctgaattcgccatcggcgagcagcgtccacggaccgtccgggccggcgccgccatacacctggtaatccttgatattgccgctcaggccctggtcctggcgtggcaggtaatgcaactgggagaagcggctctcggtgcccaggtcgatcaccagttgatggggataaccggccccggtcgccgaagcccagtaggacttggggttgccgtcgaggatgttgctgccgggcgaaccggcctgggtgctgctggcggagtggatgcgccagccgcggggcagggatttgccgcgggcatcggccaggtgcagttcggcgatgctggcgccttccttgccatccaccgaggaattggccaccagccgcacataacgcgccttgacggtttcgttctgggtggcgaaggcgtgaccctcgatcaccatgccggccacgctcttgttcttttccacgcgcaacgccaggtaccaacggccggcctgcggatcgttgaccgccagggccacgccgttgttttccagggaacggtagtcatagtcgctgacgcttggctggctgccctgcttgagcagcagttggaccttgctcgacgactcgttctgcgggccctgggtcacgctgaacaccaggcgctgggtgccgctggggacgtccagggggaagtagcgtatttcgtccttggccagatcgaccgactgttgcaacaagggtgtggcttgctcgtcggccaggggcaccacggcaggcgcgtaggcggagatcttcgccgcgttctcgcgccagaccctggccatgttcgcggtctgcgcatcgcccagcggcactccacggctgtccttgagatccgggttggagtagtagggcacctggttgccgcagaggatggtgccgacccggccgttgttatagccgaagcggtagcttttgccgtccgagcagtggctgccgccgatgttgtgcgccagttcatggcgaaacaccgtcggcccattgatgtagttgatcgagtagcgcccgttgacgtaggcccagccgaccgccgtgtcctggcctgggaccccgcgcacgaagctggcgaccaggtccgggctgtactgcttgatgccgtcggcgaacaccttgctgacctggctcagggagcccgtggtgatcggcatgtcatcgctgaccacctgggtacctaccaggcgtacacgcacgccctggatctgcgattgctgcacggcgcggttgaccgccaccacctgcgccagggcataggcttcggggtcaccgataaacctggccgacgcctccgagaagcctgccagcaggtcgatgaggatgtccccgttggcgctgcgatcgagctgatagctgcgttggccgctgcgcgattcgagcaggttgggctgctccttgcctggggcttccagggagtcctgggcatgggccgggcgttgcgggccgtcgaagcgcaacagcgactgctggccatcggcggtgccacgaatgatcgcattggcttgcggcaacagcgcgacgaagctgccatcggcgcgactggcgacaatcatttcgtcctccggctgcaagctgcggctatgggtcttgccgaccagcaccctgaggtccttgaagccattggtcgtggtcggcacgaggctgcggatgctcaggccggtttcctgttgcaggcgttgggtgccggcctcggccgtgctgcgggctcccggggcgagggtctggaggttgatgaaggggccgctctgggcggccggagcctgcgagccggtctcctgggccagtagctcgccgctcacgggcaacagtacggccgccgcgaggctggtgcagtaaaggcggtgggcgcgggaaaacgcggtcaatctgaagcgaggcataaccattcctgaaaccgcacggacgccccccagccgatcgggatcgacagagtgcctgtgcgggtaagtgatgaataaggaggtgtgccggcggccgggatcataggcggtgggtcactgccctgtacattgccccggcggcttttcgtacccgtccgaaacgctcggtgtccgggcgcaaggtatttttacgtgatgcctggaagaagcctccgcttgagagtgccgggtagcgcgcgagcaaaaacgccgggcattgcccggcgttttttgttccagcctgtcgtactcagtccgggttggacagcatcaccagcgctagcagtaccaggacgaaggccagcatgaacagcaggctgatcccggcgacgcgccacaacgagaagaaaggccccttgctgagtttgtgttcgatgacgaccggaccgaagagctggcgcgcgtaagtgttcatcgcaaaaatcggtggcagtacgaagaccacggctggaacgctttccggcagcaccgcgcccagcaccatcatcaggatgagcaggccgataccgatgtaccaggccttcttcacttcgctttcacggccgagcgccttgaggttggcggcgatcatgtaggaccccgccacggaagtgccgaggaaggtggcaaggccgacagcgttgatgctgtacaggcgcaatggcgcagtcgccgccggggtctgcgattcggcggtcggtgtctggaaggggttgggtgtatccatacaggtcaggctcctggatcttcaaaggtgcaatagggaaaaagggactgaattctcctcccgtacctcaaggcgcgtccacccgcattcttcatgcccgccagctggcgacctgttgcggggcaactcgtcagcccgaaagaaacccgcctgaattagggtaaactgccgcccattgcacacctgcgctgacaatttccctacggtatccccatgacattcgccactcttggcctgatcgaacccttgctgcgcgccctcgaaacgcttggctaccagaccccgacaccggtgcaggcgcaagccattccggcggtgctgggcggtcgcgacctgatggccgcggcccagaccggcaccggcaagaccgccggcttcgccttgccgctgttgcagttgctgtccatggaaggaccgaaagtcaccgccaactcggtacgcgccctgattctggtgccgacccgcgaactggccgaacaggtgcacgaagcggtgcgccagtacgccgagaacctgccgctgcgcacttacgcggtgtacggcggcgtcagcatcaatccgcaaatgatgaagctgcgcggcggcgttgacctgctggtggccacgccgggccgcctgctcgatctgttccgccagaacgcgctgaagttcaaccagttgcagaccctggtgctggacgaagccgaccgcatgctcgacctgggcttttccgaagagctggcgaacatttatcgcgccctgccgaaaaagcgtcagaccctgctgttctccgcgaccttctccgatgacatccgcctgctggccgggcagatgctcaacgacccgctgagcatcgaagtcagcccgcgcaacgttgccgccaacaccgtcaagcaatgggtggtgacggtggacaagaagcgcaagccagagctgttcagccacctgctgcgcaagaaccgctggaagcaggtgctggtgttcgccaagacccgcaacggcgtggacgcgctggtggaaaggctgcagggccagggcgtgaacgccgacggcatccatggcgacaagccccaggctacccgccagcgggcgctggaccgcttcaaggccagcgagatccagatcctggtggccaccgatgtcgcggcccgtggcctggacatcgaggacttgccgctggtggtcaacttcgacctgccgatcgtcgccgaggattacatccaccgcatcggccgcaccggccgcgccggctccaccggtgaggcgatctcgctggtgtgcgccgatgaagtgaacctgctgtcggccatcgagatgctgacccgccagaccctcaagcgccacgacgagccggacttcatcccggagcaccgggtgccggaaaccgacgccagcggccaagtgatcaagaaaccgaaaaaaccgaagaaacccaagacttccggcggtggcggcaagcgcaacctgggcaagtgggtggacagcggcgaagtggccgaagccccggcggtgaaaccggtgcgcaaggtgccggcgttcaacaccgggccgcgcaagcgcaagccgtaagcgatcaacatcgctcctgtagccgctggcgcagcctgcgatcgaggacgcagtcctcgtaaaaccaaacgacccggttctcctggagaagccgggtcgtttgctttggcggccgctgcgcggccgttcgcagcctcgcttcgctcggcagcggctacagggcgtaggccgggttcaggccttttcccgcaaccactcgagcatccccaaccccgctgcccgcccgctggcgaaacacgcggtgagcaggtagccgccggtgggcgcctcccagtcgagcatctccccggcgcagaacacgccgggcaattgcttgagcatcaggcgttggtccatggcctcgaacgtcacgccgccggcgctgctgatggcttcgtccaggggccgggttttcaccagggtcaacggcagggccttgatcgccttggccagcagcgccgggtcggcgaagcagtcggcgctggtcagctcacgcaagagcgcggcttttaacccatcgatgcccagctggctgtgcaggtgcttggccatggagcgcgagccccgtggcttgctcagcgcggcctggatccggtcatggggtttgcccggcaacaggtcgatatgcacggtggcggtgccgtgcttgttgattgcctcgcgaatcggcgccgacagcgcgtagatcaggctgccctcgatcccggtggtggtgatcacgcactcgccgaggcggggtatgtcgtcgttcaggccaatggccacgttcttcagcggggcaccggcgaacttgctgcgcagcagatcgctccagtcctgtacctcaaacccgcagttgctcggttgcaggggcgccagttgcacgccgcgctgctccagcggcagcatccaggcgccatccgaacccaggcgcgaccagctgccgccacccagcgccagcaacagggcgtcggcctggaccgattgttcgccttccgggctgtggatgcgcaggctgccatcgacattccagccgagccagcgatggcgggtgtggataaccacgccggcatcgcgcagacgcttgagccaggcgcgcagcagcggcgcggccttcatgtcggtggggaacacccggcccgagctgccgacgaacgtctcgatgcccaggccgtgaatccattggcacagcgcctcgctgccgaactcgcgcaacagcggggcaatctgtggggcccgttcggcataacgcgagaggaaggccgggtaggcctcggaatgggtgatgttcatgccgccgaccccggccagcaggaacttgcggcctaccgatggcatgccgtcgtagagatcgacgcgcaggcccgccaggctcagcacctcggccgccatcaggccggcggggccgccaccgataatggcgacgtgatggggcagggtggtgcgggataaggtcatggcgggcggcggcgtggcggaataagccgggcattctacccgaggccggcccgtcgccaatgctccatgcgtcccgcagtggcttatgcagggggctgatcaaaaaacgttcagtgctctgcagggcttgtatcccatgggctgcagaggcttgcgctcaggttatccacaagccgctccacagagattgggggtaaggcgcccacaattccatgaccgcctgatgaaggtttttgtagccgctgccgcaggctgcgcaaggtccgcaggacctccagcgccagtgccgacgccagcgaccgttccggtcgatcgccgcctgcggcagcggccataggtgttggtcgaaaaatgagcagcgggctggagggcttgtattgcctggcgtgcagcggcttacgcgcaggttatccacaagcggctccacagcggttgggggtaagacgcccaccttttgatgaccatctgatgacgcgaccggcccccgtttccgtagccgctgccgcaggctgcgataggtccgcaggacctccagcgccagtgccgacgccagcgaccgttccggtcgatcgctgcctgcggcagcggctacaggtgttgatcgaaaaatgagcagtgggctggagggcttgtattgcctggcgtgcagcggcttacgcgcaggttatccacaagcggctccacagcggttgggggtaagacgcccatcttttgatgaccatctgatgacgcggccggcccccgtttctgtagccgctgccgcaggctgcgataggtccgcaggacctccagcgccagtgccgacgccagcgaccgttccggtcgatcgcagcctgcggcagcggctacaggtgttggtcgaaaaatgagcagcgggctggagggcttgtattgcctggcgtgcagcggcttacgcgcaggttatccacaagcggctccacagcggttgggggtaaggcgcccatcttttgatgacaacctgatgacgcgaccggccccatttccgtagccgctgccgcaggctgcgcaaggtccgcaggacctccagcgccagtgccgacgccagcgaccgttccggtcgatcgcagccctgaggcagcggccataggtgttggtcgaaaaatgagcagtgggctggaaggcttgtattgcctggcgtgcagcggcttacgcgcaggttatccacaagcggctccacagcggttgggggtaagacgcccaccttttgatgacaacctgatgatgcggcggcactgatttttcaatggcaacccaatgacgtccacacccgttgcgcgctgtggtggaggatgccgtggcgccgggccagggcctggcggtccttgctgtagccaccgccgatcaccccgagtaccggaatgtcgcggcccaggcaatggcgcatcacctgttcgtcgcgggcggcgacaccctggtcggtcagcttcaggtaacccagggcatcgtcctggtgcacatccaccccggcgtcgtacagcaccaggtccggctggtacagcggcagcaggtaattgagggcatcgtcgaccaccttcaggtagtcggcgtcgcccatgcccatcggcagggggatgtcccagtcgctggtggccttgcgcgccgggaagtttttttcgcagtgcagcgagacggtcacggcgtccggggtatgttcgagaatccgcgcggtgccgtcgccctggtgcacgtcgcagtcgaagatcagcacccggccgacccgcccggcttccagcaggtaatggctgatcaccgccaggtcgttgaagatgcaaaagcccgccgggtggtcgtagtgggcgtgatgggtgccgccggccaggtgacaggccaggccatgctccagggcctgttcggcggccagcaacgagccgccgacggcgcgcacggtgcgccgggccagggcttcgttccagggcaggccgaggcgccgctggtcttcccgcgacaactcgccggccatatagcgttcgatatacccagggtcgtgggccagggcgagaatttccctggggcacagctccgggcgcagcaggtcggcatcgcgggtcaggccgctgtccaccaggtggtcgcgcagcaggcgaaacttgtccatggggaagcggtgttccgccgggaactcagggctgtagtcttcgtggtagatcagcggcagtggcatggcaatttcatgtaggaatccgaaaaggatcctaccagcgatgtagactggcacgcatggaaatggaggggacgatggagccgatactgcaactcgaaagtgctcgactgctgttgcgccagtggcgtgatgaggatttgccggcgttcgcggcgatgtgtgccgacccgcaggtgatgcgttactttccggcccccttgagccgcctggaaagcgctgcgctgatcgggcggatccgtgggcatttcgccgagcacggttttggcacgtgggcgctggagcgcaaggataccggggcctttatcggttttaccgggctgggcgtggtgggcttcgaggcgccgttcaccccggcggtggaaatcggctggcgcctggcgcgcgagcactggggcctgggctatgccagcgaagcggcctggaccgcgttgcgctgtggcttcgatcgcctggccctgaaggagatcgtcgccttcaccaccaccagcaacctgccgtcgcagaaagtcatgcaggccatcggcatgcaacacgctgcggacgacgatttcgatcacccaaagctcggcagcgagcatccgctgcgtcatcatgtgctgtatcgcatcaaccgcgaacaatggttggaaaccttgcatggatagcaggtcgggggcatctggagtgtgcccatgtgtgtgaacccgattgaatcgaccgcggcagcgaagactgcgcggcattgctctgtgtgaggagagtctgaatgagccacgtgttggatgatctggtcgacctgttgaccctggaaccgatcgaggaaaacctgtttcgcggtcgcagccaggacctgggtttccgccagctgttcggcggccaggtgttgggtcagtccctgtccgcggccagccagactgtcgaagaggcccgccatgtgcattcgctgcacggttatttcctgcgcccgggcgacgccgcgttgccggtggtgtaccaggtcgatcgggtacgcgatggcggcagtttcagcacccgccgggtgacggcgatccagaagggcaacccgatcttcacctgcagcgcctcgttccagtacgacgaggaaggcttcgagcaccaggacacgatgccccaggtggtcggcccggaaaacctgccgtcggagctggagatcacccagcagcgcgcgcacctgatccccgagcacatgcgcgaaaaactgttgtgccccaagcccatcgaagtgcgcccggtcaccgagaaagatccctacaacccgcagccggcggacccgatcaaatacgtctggttccgcgccgacggcagcctgccggacattcccgcgctgcataaatacctgctggcctacgcctcggacttcggcctgctgaccacctcgatgctgccccacggcaagtcggtgtggcagaaggacatgcaggtcgccagcctcgaccacgcgctgtggttccatgccgacctgcgcgccgacgactggctgctgtatgccatggacagcccgtgggccggcaattcccgcggtttctcccgtggcagcgtgttcaaccgcgccggccagctggtggcgtcggtgacccaggaaggcctgatccgccaccgcaaggactgggcatgagcctggccgaggtgcggcattgggtgttcgacatggacggcaccctgacggtggccgtgcatgatttcgcggctatccgcgaagcgctggggatcccgccggagcatgacatcctgacccacctcgcggccttgcccgccgctgaagccgcggcgaaacacgcctggctgctggagcacgagcgcgacctggccttgggttcgcgcccggcgccgggggcggtggaactggtgcgggagctggcggcgcggggctatcgcctgggcatcctgacccgcaatgcgcgggagctggcccatattaccctggaggccatcggcctggccgactgctttgccgtcgaggacgtgctggggcgcgacgaagcaccgcccaagcctcacccgggcggcttgctgaagctggccgcggcctgggaggtggcgcccgccgagatggtgatggtcggcgactaccgcttcgacctcgactgcggtcgcgcggcgggcacccatacggtgctggtcaacctgccggataacccgtggccggagctggccgactggcatgccgaggattgcgtggtcctgaagcagatgcttttggcctgagatccatcgcgagcttgctcgcgatagcgttcttgatgatctcactctgtttattggccgagcttattggccgaacaatgccttctgcccttcgggcgaagtgaacatcttgtcgccgtcatgcccgaccccgggcacttcgatcagttgctgttgcaatccctggggatgacgctgtttcaggtagttgaaatagttgtgcccgcgaatcaagcggtaggcgccctgggcctcggcggcgcagctggtgtccagcgccgggtggtgcgggtcggtgtcctgtttgcccagcaggtaggtgatatcgcgcttgacgtagctctgttccagttgctgcgcggtctggccggcggcgtaggccggcagcttgagcaggccgtacttccagtggttgaagccggggcacgcgccggcatcgaccttcaccgggcgctgctcgtcgaaataggcataggacgacgggttggcgatgacgtagcgcagcttgatgccgtcatcctccaggcccggatggtgctggccgagcagggcgaaacgctgcaccacctgggcgccaccggagtggccggcgatgacgatctcggtcagggacgggaactgctggcgatcgctcagccgcgtgatgatcgcgtccagcaccgcataggaactgaccgtcctgggcccgctggacggctcgccggccatccagtcattgccctgccagcgcagcagcgagtcgggtagtgggtgacgctcgatatcgctctggttgagaaactgcggggcgaccaccagggtggacgcactttgcccggcctggctggcggcctgttcggcgctttgcaggtaggtctgggcattacgcaggcgcccgtggacgatgatcagcgcccgctggacctcgggcagcggccgctgccagtcctggctcaggccgatggccagttcgccgccttcgaggttcagtcgcgcggggctgatcgtcttgacgccattttccgctgcctgcgcgccggcgcagatcatccataacgtgagcagcaccagtacccggcgcattacagactcttcgccgcgaaggtgtcgcactggccgacttggccttgagcgaaacctgtcttgaaccagcgcacccgttgcgccgagctgccatgggtgaaggagtccggtaccacgcggccctggccttgctgttgcaggcggtcgtcaccgatggcgttggcggcgttcagggcttcttcgatatcccccggctccagccagttcaggcgtttctgcgcatggttggcccagacgcccgccaggcagtcggcctgcagttcctggcgcaccagcaggccgccgtcgccttccatctgccggccttgttggcgggcggcctggatcttcgccgagacgccgagcagggtctgtacgtggtggccgatttcgtgggcgatcacgtaggcctgggcgaagtcgccggcggccgagaagcgctggtccatctcgcggaagaagtccatgtccaggtacacctgctggtcggccgggcaatagaacgggccggtggcggaggtcgccgagccgcaggcggagttcacccggccacggaacaggatgagcttgggttgctgataggcgcgtccggcctgttggaagatctggccccaggtgtcttcggtgtcgccgaggatggagcgcacgaattccgcctgctcgtcgttggccggcggcgcctggcgggtctgctgggtggtggcgggcgccgaggactggtccatctgcccggcgagctgcccgaggatttgcaacgggtcctggccggtgacccagccgatgccgacgatcaggatgatggcggtcaggctcagccccttgccgccgccaaagcgcagaccgccgccaccgccgccactgtcatcgcgagcatccaccacgttgtcgctgcgccgtccttttttccaaagcatgggtgaatcctcgttctaatttgctgatcagtgttgctggtgagtagggcagacgccagtccggtcgtcagccttttgcatgcacgctaccattgcccgcagccgcatcgatcctgtcgcgacacatccggggcctcctttgaacatcgatacccgcatcaaattccgtcacctcgtatgttttcttgaaatgtctcgccagggcagcctggcgcgggcggcggatgtgctcgcggtaagccagccggcgatgtcgaaaaccctcaaggaactggaagaactgctcgacacccggctgttcgccaggagcaaggccgggctcagcctgaccgaggccggcatggcctttctgcgttacgccgggccctcggtgcaggccctgcgcgagggggtgaacaccttgcgtggtggcgaatatgccgccggcgtggtgcgcctgggtgtgctttcgaccgccgaaagcctgctgctgccggaggtggtgcggcgcctgcacgaacggcattcggcgctggtggtgagcgtggtcaccggccccagcgcctacctgctgtcgcagttgcgggtcggcgatgtcgacctggtggtcgggcgcatgacggacagcccgcagatccagggcctgagcttcgagcatctgtacagcgagtccatgaccctggtggcgcgtcccgatcacccgttgctgcacgggccattggaccggcatgcgctggagcgctacccgctggtactgccgctggccggcaccaccatccgcaaattcgccgacagcctgttcgtgcagtgcggcatcagccagtcgcgccagcgcctggaaaccctctcggtggccttgagccggcgttatgcgctgtccagcgatgcactgtggatcgccccgctggatgcggtgcgcctggacctggccaatggcgagctgcgcgagatcgacctggggcagcgtgagccgggcggctcggtgggcatctccagcaacgccagcctgccgctgtcgctggcggcgcaatggtgcgtggaggtgctgcgggaggtcgggcaggcctatcgcgaggggcgttacccataaccgttcggttatgttcttgagggggcttttcaatagtcgtcgggctgccgttgtttgaaactgcgcgggctgcgctccataaatcaaacaacaggagaccgacatgtctgatgcagacagcagtcgcttcgttatccgtgaccgtaattggcatcccaaggccctgacccccgactacaagacctccgtggcccgttcgccgcgccaggcgctggtgagcatcccgcaatcgctgagcgaaaccagtggccccgatttctcccatctgaagaccgggcgtttcgacaacgacctgctgctcaacttcaataacggcggcttgccggtgggcgagcggatcatcgtcgccggccgggtctgcgatcagtacggccagccgattccccacaccctggtggagatgtggcaagccaacgccggtggtcgctaccggcacaagaacgaccgctacctggcgcccctggacccgaacttcggcggtgtcggccgggccctgaccgaccgtgacggctactacagcttccgtaccatcaagcccggcccttacccgtggcgcaacggcccgaacgactggcgcccggcgcatattcacttctccatcagcgggccgtcgatcgccacgcggttgatcacccagctgtatttcgagggcgacccgctgatcccgctgtgcccgatcgtcaagtcgatcgccaatccgcaggcggtgcagagcctgatcgcgcggctggacatgagcagtgccaacccgatggactgcctggcctatcgcttcgacatcgtgttgcgcggccagcgcaagacccacttcgagaattgctgaggagcccgccatgcctatccaattgctgcccgaaaccccttcgcaaacggccggcccttatgtgcatatcggcctggcgctggccgccgcgggcaacccgacccgcagtgacgagatctggaaccggatggccgggcccgacgcccagggggaaaagatcctgctgatcggccatgtgtacgacggcaacggccatctggtgcgcgactcgttcctcgagttctggcaagccaaccacgagggcgtctacgaccctgtgttcgattcggagaaagccttcaacagcttcgggcgcacggccaccaccttcgatgccggcgagtggacgctgcacacggtcaagccgggcgtggtgaacaacgccgccggggtgccgatggcgccgcacatcaacgtggcgctgttcgcccgggggatcaacatccacctgcacacgcgcctgtatttcgccgacgagccggaagccaacgccgcctgcccggtgctgaacctgatcgagcagccgcagcggcgcgacaccctgctggcgcatccctgtgacgtggatgggcagcgggcgtaccgcttcgatatccgcatccagggggaaggggagacggtgttcttcgatttctgatctgccatccgtcaccgcgggcgtctcctgcggagccgatcgcagcctcgcgggctcggcagcggctacagggattccgtgctttctgtagccgctggcgcagcctgcgataaggtccgcagggccttcaagcgatctcaagaaccacacccttttcgaagttgaatgccgccttattcgtaagcgctggcgcccgcgatgtgccgcccggcgatatagccaaaggtcagcgccgggccgagattgatgccgccggcggggtagtggccgcccatgatactggccatgtcgctgccggcggcgtacaggccggcgatggcctggccttggccgtcgagcacctgggcgtgggggttgaccttgagcccggcgaaggtgccgaagcagcccggctggactttcaccgcgtagaacggcccctgttcgatgggcgccacgcacgggttgggttgctgacgcgggtcgccctgcttgcggttgtagggcgtcgagccccggccgaacagcgggtcctggccttgtcgggcatgccggttgtattccgccagggtggcgcgcaggccgttcacctcgatgccgcaggcctgggccagttcctcgatgctcgcgccgcgcttcaggtaactactgtggataaagggcgccagcggcaccgggaagggccgggagatgcccaggccatagcggcgctggaagccgtggctgcagatcagccacgacgccacttcttcgccctcgggcgccgccgcgaccattgctcgcacatagtcgtagtaaccgtcggcttcgttgacgaagcgttggccgttgcgcaagacaccgatgatccccggcttgccgcgctcgatgatgtgcgggaaatgcccgcggctgccgtcctggtagggcaccgcggagaccggggcccaggccacgggggattccatgtcggtatcgacccgggcaccgacgctttcccccaggcgcaagccgtcgcccgagaccgccaacggcggcagggccagatgctcgtggccggtgggcgtgcgtgggaacagcgccttgcgccgctcgatgtcgttggcgaagccaccggccgccagcaccaccgctttgcgggcgcggatacgaatgggcccccgggtggcgctgctgacaatcgcccccgtcaccgcgtcgccgtcacgcagcaattcggtgaccggcgccgattcccagagcagtacgccaaggtcctgcgccgacttggccaggcgcgccaccagcgccacaccgttgaccagttgcagggcgcggcgatgggtgacgaggtcgcgcaggtggcgagcgacgcgtttgctcacatgccaggccgccggcggcgaacggctcaggttgaggaaggccgcaaggtcggcgccggccatgatcggcatgccgatgaacgaggtttcgcgcatggtcttgcgcaggcgcttgagcagcgtgccgacctcgcgcccatcgtagggcgcggcgatcaccgagcgtccgccggtgccggcgcccggcgtatcgccgtggatatcggcgatggcgttgccgtcggcgaattgcagcgcggtatggcgctcgaagaacgacaccatgcgcggcccggcttcgaggaaggcgtcgatcagtgctggctggtagcgttcgcccagttcatgtttcaggtaggtgcgcggcagttccacgtcttcgactatgccggcccgtcgcgccagcgggttgcacggcacccaggcccagccgccggaccaggcggtggcgccgccgaacaccgggtctttctccaccactatgaccttcaggccatgccaggccgcggtcacggccgccgaaaggccggcggcgccggagccgacgaccagcacgtcgcaatcgatatcggggtggtgcagggaggcggtggcaggcatggaagaagcaactccgctaaacgaacgattattatttttggaacttgattccaaaaaatatacggagtcgaatagtcggcagcaaggcgagggcgggatcatctgcgccgtgccgaggtttttatgggcggttatcgaacgaggccgcggtgtgtttcccattgcgccggttgtcactagaatcggccaaatttcgtctggacccgaccatggccggcagtcaaatcgagcgcgtcttcagcgttctggaaagtcttaccagcgacccccgcggcctgccgatgcagaccctggccgagcaactgggcatccccaaaagcgccacccaccggctgttggcggagctgatccgcctgggctacgtgcgccagaacccggacaacctgcgctatcacctgtcgaccaagctggtggccatgggctttcgctacctctccagcagcggcgcggatatcgtccagccggtgctcgaccggctggctcaggaaaccggcgagctggtgcgcctcggggtgatcgaggacgagcgccagacctggatcgccaagtcccagggcgcccgttccgggttgcgctacgaccccgacatgggccgcgaggcgccgttgttctataccgcttccgggcacgcctggctggcctgcctgagcgatgccgaggcgttgtcgctggtggagcgccaggcggccgagatccccgcggacctgggcccgaacgcgccgcgctcgaacatcgaactgctcgaacgcctgcgcctggctcgggaacagggttacgcctgggtcgaggaaagctcggcggtgggcacctcggcggtggccgcggtggtgcgtcatccggtcgacggccgggtggtcggagtgctgagcatcgccggccccagcgcgcgcatgccgctggcgcgcctgcatgaactggcgccgctgctgttgaagttcaccgacgaactctcggccgccagccaggcctccgaactcttcagctgaccctgtagccgctggcgcagcctgcgatcggctccgcaggagccgcaaaaccgctcactacgggtggggcaggctgagcgcggtcgcctattttacggccgctgcgcgcccgatcgcagcctcgcggggctcggcagcggctacagggtttctccgtttttctgtagccgctggcgcagcctgcgatcggctccgcaggagccgcaaaaccgctcactacgggtggggcaggctgaacgcggtcgcctgttttacggccgctgcgcgcccgatcgcagcctcgcggggctcggcagcggctacagggtttccccgttttctgtagccgctggcgcagcctgcgatcggctccgcaggagccgcaaaaccggccactgcggtggggcaggccgaatacggtcgtctgttttgcggccgctgcgcgcccaatcgcagcctcgcggggctcggcagcggctacagggtttcctcgttttctgtaggcgctggcgcagcctgcgataaggctcgcagggcctttgcgatctcaagccttaaagctgttcgctgatcggacactattttgttttgctcttgtatgaaaatggaaccgagttctaaatatttgaaatttcgcgttcccataacaatcacaagaggatcccgccttggactcgcctttgcgcattgccctgatcggcgtcggcaatatgggccagcagcattaccagcacctcaagaccctcaccgaggccagactctgtgccgtggccgaccccggcccgcaagcagccgggatcgccgcgcagtggcaggtgccgtattaccccgaccatggactgatgctcgaacaggcccgccccgacgccgtgatagtcgccaacccgaacaacctgcacgtcggcactgccctggattgcctggcggccggtgtgccggtgctgctggagaaaccggtcggcgtgcacctggatgaagcgcgcgaactggtggccgtggtgaaaagcagcggtgttcccgtgctggtgggccatcaccggcgccacaacccgctgatcgtccgtgcccatgcgctggtgcggggcggggcattgggccggttgaccacggtcaccgcgctctggcaattgcagaagcccgacagctatttcgagattccctggcgtcgcgagcccggggccgggatgctgctgaccaacctgattcacgacctcgacctgctgcgtcatctgtgcggcgaggtgcatcaggtgcaggccgtcaccagcaacgcggtgcgcggttttgccaacgaggattgcgccgccgtcctgctgcaattcgccaacggtgccctgggcagcctgaccggttccgacaccgtggcggcgccctggagctgggagctggattccggcgagaacccggtgtatccgcgccaggccgaccagccgtgctacctcttggctggcaccggtggcgccctgagcattccgcaactcaagcgctggcagtacgccgaggccggcgccggctggcatcagccgttgctggcgatcgaggagcctttcaccgccgccgaggccctgcgcctgcagttgcagcatttcgtcaaagtggcgcgacgacgaggtcgagccgctggtcagcgtggcggatgcagcgcggaccctggcgctgatcgaggcgatccgtgaagcggcggcgaccggtcgggcctgtgccccggcgccgatcgagggatgagtatgagcgaacgcattctttccctggccagcctcacggtgctggagatctcgccgccgcagatggtcgaggtggcggcccgtgccggttacagccacgtcggtttgcgcctggtgccggcgacgccgcaggagcatcactttgccctggtggccgatgccgatctgcgccgacagaccctcagccgcctgcgcgacaccggcgtcggcgtgctggatgtggagatcctgcggctcaagccgcacacccgggtcgcggatttcgaagcggtgctggcggtcggcgcggagttcggtgccagcgagctgctggtggccggcaacgaccccgacgaagcacgcatgaccgagcgtttcgccgaactgtgcgacctggcgtcgatctacggcctgcacccgcacctggagttcatgccctggaccgatgtacgcaacctgcagcaggcagtgcgggtggtggagaacgccaggcgcgataacgctgcggtgctggtagacgcattccactttgatcgctcggcctcgcgcctggaggatctggcaaaggtcgcgccgtcacggctgcgttatgcccagctgtgcgacgtggccggcccgcgaccggacgatatgcaggagatcctgcgccaggcccgcaacgagcggcgtttccccggggatggcgattgcgacctggcggggctcttgcattgtctgccggccaacttgccgttgagcctggagatccccgcggtgaaattgctcgagcagggcgtcggcgccctggagcgggcgcagatggccctggacaagacccgggcgttgttggccaggatttaatggatagcccggatggccctatcgcgggcaaggactgggcgcacagtccttgcccgcgaagctgtttttctacaaacaaaccctatcatgagagactccgcggatgaccctcagcacacccctttccggtgtcaaccagcccttcaagggcatcctgctggtcgtcgtggcgaccttcctgttcgccagtcacgacgccctgtcgaaatacctttcggggttctatccgatcatgatggtggtctgggcccgctacctggttcataccctgctgatggccgggatcttcctgccgcaatcgggcctgcgggtgttgcgcaccaagcggccgttgctgcaaatagcgcgggccttgtgcctgctcggcaccagcctgctgttcacctcggcgctgctgtttatcccgctggcggaagccacggcggtcaacttcctggcgccggtgctggtcaccgcgctctcggtgccgctgctgggcgagcgggtcacgaagggccagtggctggcggtgatctgcggttttatcggggtgctgatcatcgttcacccgggtggcgacctgttcaccccggcggtgctgctgcctttctgctcggcgctgtttttctgcttctaccaactgctgacccgcaagctcgccgagcacgacagcccgaccaccagtaacttcttcgccggcctgtgcaacaccctggtgatgagcgcgctggtgccgttcttctggcaggtgccgagctttgtccatggcgcgctgatgctggcgctgggggcctgcggcatgaccgcccacctgttcctcacccaggccttccgccacgcggcgccggcgctgctggcgccgttcggctattgccagatcgtcttcgccgggttgctgggctggctgttgttcagccatacgccgcagccgatcacccaattgggcatcgcggtgatctgcctcagcggcctggcggctgcctggcaacagcggcagcgctgagtggcgttggtaacgggaggacagtgagagaagcgggggagaaaaaagcaggcccggaaccgggcctgcgagaggaaagcgtcagtcttctactttcggaatcttgcggggagccatgaagtacatccaggtcagggcaatgaagtacatcgccgggatcagggtgaacaacacggtgtagttgttgttggtgacggtcaggatgtggccgacgatctgggtcatgaacatgccgccgatggctgcgcacataccgccgaaaccgaacaccgtactcatcatgtgcttgggcgtgtagtccatcaccaggctccagatgttggcggtccaggcctggtgcgcgccgatccccagggagatggcgaacactgccagccataggctggaggtaccggctgccatgatcacgccgatgatgcagcaggcgaacaggaacatggagaccaggcgcgccttgatcgggttgaccccgcggccgatcaggaacgacgagaggatgccgccaccgacgctgccgaagtcggcggtcaggtagatgatgatcagcgggatgcccatctgggtcacgttgatgcccaggttgtactgctggttgaggaagggtggcaaccagtacaggtagaaccagaacaccggcgcggtgatcgcgtaggccagggcgaaggcccaggtgccgcgcatgcgcaggatgcgcgagaaaggcacgcgggcctgctccggttcgacttctttctggatgtactcgagctcggactgtttgacgctcgggtgatcttccgggttgaagtacttcaggccccagaacagcagccagatgccgcccagcgcagccatgcacaggaacgccgcctgccagccccaggcgtgcaggatcaacggcagcagcattggcgtgaacatggcgccgacgttggtcccggcgttgaagatgccggtggccacggcgcgttcgccggccgggaaccacaggcgcgtggtcttcacgcaggccgggtagttggcggcttcggtcagcccgaggatgaagcggcagaccatgaagcccgcggccgaagtggccaggccgtgagcgccggtggccaggctccacagcagcacggcgaagaagaacacgcgcttgacgccgacccggtcgatcaaccgtccttgcaggacgaaaccgacggcgtagccgacctggaaccagaagttgatgttggcgtagtccatcgccgtccagctcatttccttggccaggatcggctgcatcacacccagggcggcgcggtcgatgtagttcagggtggtggcgaagaacaccagggcgagcatgccccagcgggtcttgccgaccgccatggcgccgcggatcttgtcgccgatgccgccggaggcggtgccgaggctcggggccatgcgggagctttgagaaggaatcatgtgtgccatccgttcaatgactgacgagggacaactcgtcgggactcaagggcgcgtgatcgattgtcgactatgcggacgggccgcgggtgaactcgatgatcgatcggctgagtgctttggtcgacgcgcgtcgggcgcggcggtggaaagcgggttggtcagcgtgcgggcatggtcagcccaggggccgtagtgcgtccgtctgaaggaggctgttggaggcgtggccgggtgagggccgaagggccaggcagagaggtgtggcgttgagtgcaagcatgagggtgtacccgatttttgaaatttttatggtgtgttctgggtcttgggtgattgaagccggcggttcggtgccggctcaatgtgttgccgatggtgcgcagcggacgaaaaatcgtcaattcgccaatggccattttgttcgataatcgcacgaaaaactaactggttcgtacactttgaattgctgtctgtactgcccggctcaataatccgccccatccaataacaaacgtacctgtagccgctgccgcaggctgcgatcgcccgcgaagcgggcgcgggatcttcagtgcgctggaggacctgcggcagcggccacaggcacggcgcccgatctgtggtcattaccgggagttgaaacatgcagcgttccattgccaccgtctccttgagcggtaccctgccggaaaaactcgaagccattgccgccgccggtttcgacggcgtggagattttcgagaacgacctgctctactacgacggcagcccccgggaaatccgccagatgtgcgcggacctgggcatcgccatcaccctgttccagccttttcgcgatttcgaaggttgccgccgcgaccgcctgcaacgcaacctggaacgcgccgagcgcaagttcgacctgatgcaggaactgggcaccgacctggtgctggtgtgcagcaatgccgcggccgacagcgtcggcgaccggcagatcctggtggacgacctgcgcctgctggccgagcgcgctggcagccgtggcctgcggatcggctacgaagccctggcctggggccggcacgtcaatacttatcaacaggtctgggacatcgttcgcgaggccgaccatccgagcctgggcgtgctgctcgacagcttccacaccttgtcgctcaagggcgacccggcggcgatcgccgagattcccggggacaagatcttcttcgtgcagatggccgacgcgccgatcctggccatggacgtgctggagtggagccggcattttcgctgcttcccggggcagggcgatttcgacttgccggggttcctcgcgccgatcatcaagagcggctacaccgggcctttgtccctggagatcttcaacgacggtttccgcgccgcgccaccgcgggccaacgccgcggacggcctgcgttcgctgctgtacctcgaggagaaaacccgccagcgcctggaacaggaagccgcgccggtggccaatatcgatacgctgttcgcgccgccgccggccagtgaatatggcggcaccgagtttctcgagttcgccgtggacgaagcgctgggcgccaagcttggcggctggctggaacgcctggggttcgccagggccggccagcaccgctcgaagaatgtcagcctgatgcgccagggcgatatcaacctgatcctcaactccgagccttattcctttgcccacagcttcttcgaagcccacggcccctcggtgtgcgccacggcgatccgggtcaaggacagcgccaaggcgctggagcgcgcggtggcctacaagggccagccgtaccgcggcttggtgggccccaacgaactggaactggccgccgtgcgcgagctggatggcagcctgatctacctggtggaccaggagcagggcggccagcacctgtacgacaccgatttcaatatgctcccgggcgtggtggccaagggcggcctcaagcgcatcgaccacatggccatggcgctgccggccgacagcctcgacagctgggtgctgttctacaagagcctgctggatttcaccgccgacgacgaagtggtgctgcccgatccctacggcctggtgaagagccgggcgctgcgcagccgttgcagcaccattcgtttgccgctgaacatttccgagaaccgcaagaccgcgatctcccacgcgctgtccagttacggcggctcgggcgtgcatcacatcgccttcgattgcgacgatatctttgccgaagtcagccgggccaaggaggcgggcgtgccgctgctggacatcccgctcaactactacgacgacctggcggcgcgcttcgatttcgacgacgagttcctcagcgagctggcctactacaacgtgctctacgaccgtgacgcccagggtggcgagttgttccatgtctacaccgagccgttcgaggggcgcttcttcttcgagatcatccagcgcaagaatggctatgtcgggtatggcgcggcgaacgtcgcggtacgcctggcggccatggccaagtcgcgcagcggtggggtacggcacgcgaagttgtaggagtttcgtaacggcggcggcaaagggccgccgtcctgctttccttcgctgcgcgaggcggcccataatcgcccgcgtgtgcagcgatggccgtgagccccagaatgacaatgaccacagaactctccgtagcgcccgagcagcccgtgatcgagccacgcaagagtcgcaagaacaacccggaaaagacccgcgagaacattcttcaagaggctattgtcgagttcgtgcagcagggcctgtccggtgctcgggtggatgccatcgccgagcgcatccatacctccaagcgcatgatctattactacttcggcagcaaggagcagctgtacgtcgaggtgctggagaagctctacggcgatatccgcaacaccgaaagccgcctgcacctggcggagctggcgccgcgcgaggcgattcgccggctggtggagttcaccttcgatcaccacgaccgcaacgtcgatttcgtgcgcatcgtcagcatcgagaacatccataacgccgaatacgtgaagcgctccgaagcgatcaaggcgatgaacaacaccatcctgcatgccctgggcgagatccttcggcgcggggccgacgagggcgtgttccgcgccggcctggacccgctggatgtgcacttgctgatcagttcgttctgcttctaccgcgtgtccaaccgccacacttttggcgagatcttccagatcgacctgcccgacgaagcgatcaagcagcgccaccgcgagatgatctgcgagtcggtgctgcgctacttgcaggcctgatcctctaggcggttgaaccccgctgtcgatcgatcagctggcacagggttgcaaccgcatcctgcatcgactccgcccgggtattgccaaagcccatcagcaagccggggcgtgatccgccctgggcacccacgaaaaaacctgacagcggcgcgacgccgatcttccggacatgggcggcggccgcgatcgcctggtcgtcgagcccatcgggcagttcggcgagcaggtgcaatccgctggcgctgctggctaccgtcatgcgctcgctgccggcgttgtgaatggccgccagcaaggcggcgtgacgctgcgcataaaccgcctggctacgacggatatggctgccgaggtggccattgccgatgaactccgccgccgtcgcctggagcgacaaaggcacgcggtggccgctgccattgcgcacgttgcgcaacacctccaccaccgcctcgggggcgaccaggaagcccaggcgcaggcccggcgccagcagcttgctcaaggtcccgacgtaaatgacccggccctgattgccgtccagggccttgagcgccggtgttggcgcgccgccgtagcgaaactcactgtcgtaatcgtcttcgaggatgaaggcatcggcatcgtgggcccattgcagcaaggccaggcgtcgcgccaggctcatgccgacccccaggggatactggtgcgaaggcgataccagggcgagcctggcgtcgggcgcgagccggcggccggcctgcacatccaggccttccgcatccaccggaacgcccacggcctgcacaccggccagcagcacgctgcggtaggccgcatcgtagccggggttctcgacccagacccgctctcccaggtcggtgagcgccagggtggcaatcgacaccgccgcctgggcaccgggggtaatcacgatgtgactggcctggcacaccactccgcgcgccgcgccgagatacgccgccagggcttcgcgcaatggcaggaaaccctgcgggtcgccgtaggacaggtcgggaagtggccggcgtcgccagaagcggccttccaggcgcccccacagcgcatagggaaaggcgtccagcgccggcaggcccggggtcagcggccaggcggcccgggccacggacatcgagtcggtccccgtcagcgcccgggcccgggtggaaccgacgggggcctctgtccgggcgggcggcgaggccgtttgctcggcgatccgcgccatgacgtaggtacccgaacctgtccgggcttccaggaacccctcggcgatcagctgcccataggcttcggtcacggtcatgcgcgatagccccaactgtgtcgccagcacgcgtgaggcgggcaggcggatcccggccttgacgctgccgtcggcgatgcctttgcgcaggaacagcagcaattgctcgcgcaaggacaagtggccgtccttggccagttgcagacggttccagatgggataggcggttttgcgggttttcatcgggggcctggggatcgccggtcggcgacagctggaaaagtggtctgggatattgatcgaaagtggatattttatacaggccattgcctgcggatactccctcgccttgccaacacagccagagggtttccccgatgaaaaccgccagcatcagaatcgctgacctgctgcatccaagcgttgccgcgctgatctcggtcatcgtcaattacgggggaaccttcattctggttttccagggggccaaggcggccgggctgagcccggagcagaccgcctcgtggatctggtcgatctctatcggcgtcggcctgaccggcgcctggctgagctatcgctaccgcgagccgatcattaccgcctggtcgacaccgggcgcggccttcctgatcgcggtactgccgggcacgccttacccggaaatggtcggcgccttcatgctgtcggctgccggcttcgtggtgctgggcatgtcgggttatttcgagcgggtggtgaagctgatcccgccggggatcgcggcgggcctgctggcgggtattctgttgcgcttcgggattggtgctttcgacggcgcgggggtcgatcctttgctggtgggcgcgctgctgctcagctatgtactgctacggcgctttaccgcgcgttatgcgattgtcggggtgttgctgatcggtatcgtgctgttgctcgggttggggcaggtcagtttcgccagcctcgaactcaagccggccctgccggtgctgaccgtgccggtgttctcgctgaatgcgctgctgagcgtggccctgccgttgtttctgatcaccctgaccggccagtacatgcccggcatgctggtgctgcgcaacgatgggttcaagaccagtgccaatccgattctcaccgccaccggcctgggctccttgctgatggcgccgttcggttcccatgcgttcaacgtcgccgccattaccgctgccatctgcacgggcaaggaggcgcatgaagaaccggccaagcgttatctggccgggcttgcgtgtggggtgttctatctgctggtggggatcttcggcagcaccctggcggcgctgttcgtggtcctgccggcgacctttatcaccaccctggcgggcctggccctgctgggggcgatcggcggcagcctcgccaccgcgctggtcgagccgagtggccgggaaaccgccttgatcaccttcctggcgaccgccgccaatatcaccttgttcgggttgggcggcgcattctggggcttgctggcggggttgctggcgcacggcgtgatgcacggacggctgcggccagccggtcgccatgaacgcgcctagtcgccatgcatggccgcggggagtgtggcaggtacctgtcgagagcggagctgattacagctccgcactgacccggtcaggcactgtcagccattcatgctctggaaatgcgcgagcatgcgctgggcatccggcgttatgccgctgaacagctcgaacgccttcaccgcctgaaacaccgccatgttgccgccgtccagggtgcggcaaccgagggcgcgggcgttgcgcagcagctcggtttccagggggaagtagacgatctccgcaacccacagcccagggcgcagcaactcgaccggtaccggcatgcccggcagcttggccatgcccacgggcgtggtgttcaccaggccgtcggcggcggccagggtggcgggcaggtcgacgccggccttggcccggccagggccgaaatgctggttgaggttatccgccaggctctgggcgcgggcgctttccacatcgaagatgctcagttgctgcacgccttcgctgagcagcgcatgggccaccgccgcaccggcgccgccggcgcccatctgcaccacgcgcgccagggccacgccttgtaagccgcggcggaaaccttcggcaaaacccaggcaatcggtgttgtggccgacgcgcttgccgtccttgagcaccacggtgttcaccgcgccgatgccgcgggcttccggcgacagctcgtcgagcagcgggatgatgctctgcttgcacgggaaggtgatgttcaacccggtgaagttcatgcgttcggcggccagcagcaggtcgggcagggcgttgctgtcgagttgcagctggtccaggtcgatcagccggtacagataacgcaggccctgggcgtcgccctcgtgctcatgcagcgccggggtgcgcgaggcctggatgccggcgccgatcagtccggccagtactgtgttctgctgggtcatgcctgggctccttgaaagcgctggctgaaatgcgccagtgccaggcgatagccatggctgccaaagccgcacattaccgccagggcgatgcccgagacaaaggaatgatggcggaacggttcgcgggcgtggacgttcgacaggtgcacttcgatcaccggcaactcactggccaccagggcatcgcggatcgccaccgaggtgtgggtccaggccgccgggttgatcacgatcccggcgcaacggccacgggcgccgtgaatccagtccagcagttcgccttcgtggttggtctggcgaaactccacggtcaggccgaactcctcggcggcacgcccgcacagggcggaaatgtcggccagggtctcgtgaccataggtggcgggttcgcgggtgccgagcaggttcaggttcgggccgttgagcaccagaacgatagggcgcatggggggaattctccgttgttattgtgggcgtggcttgagcggccagcggctggagctaaattgtactaactagttaatttggtcagttgcgacgggagaaggcaaggcaggtcctgtcattaagtgttcggtgatcgaacatgttcatgccgcagccagcgagtgcttgccacttggccagggttgccggagcttgcggaccggcctcaatcacgccaggcgagggttcatcgataaaggtggcagcgcacaaggcgcaggcgttgtcatgaaagggcgcagccacaaaaaagccgtcgcagggacggcttttttgtggttcgcgacaggccatcaacgccgggtcagcaagactccggattccatgtggtgggtccacgggaactggtcgaacatcgcgcagcgggtgatgcggtgggtgtcgtgcaactgggcgatgttggccgccagggtctctgggttgcacgagatgtacaggatgttgtcgaagcgccgggtcagctcgcaggtgtccgggtccatgccggcgcgcggtgggtcgacgaacacgctgccgaactcgtagctcttcaggtccacgccctgcaggcggcggaacggacgcacttcgttcagcgcctcggtcagctcttcggcggacagacgcaccagggtgacgttatccaccgcgttttcactgaggttgctcagggccgcgttgaccgaggtcttgctgatctcggtggccagtaccttgcgcacccgggtggccaggggcagggtgaagttgccgttgccgcagtacagctccagcaggtcgtccgggcgatcgcccagggcgtcgtaggcccagttgagcatcttctggttgaccgtgccgttgggctgggtgaaggcgccttcgggctggcggtagctgaaggtgcgcccgccgacttcgagtttctccaccacgtaatcgtggccgatcacttcgcgcttgcctttggaacgaccgatgacgctgacgttcagctcggccgccaactggctcgccgcggcgtgccagtgttcgtccagcgggcggtgataacacagggtgatcatcgcgtcgccggccagggtggtgaggaattcgacctggaacagcttgtggctcaaggcgctgctggcttgccaggcggccttgagtcgcggcatcagctgattgatgcgcaggctggcgatcgggaactcctcgatcaggatcggcgtgcgtttgtcttcctgggaaaacatcgcgtagtgacgctcgccggcttcgcgccacaggcgaaactccgcgcgcaggcggaagtgctgcagcggcgaatcgaagacctggggctcgggggcatcgaacggcgccagcagttgacgcaggcgcgcgaccttgtcggcgagctgggtggcgtaagcctgggaatcgaaagtcatgcgttgaaccaacccaacttgatcacaaacagtaccgacagaattaccagcggcgcgttcagctcacgggcacggcccgacagcagcttgatcgcggtccaggcaatgaagccgaaggcgatgccgttggcgatggagtaggtgaacggcatggccagggcggtgaccaccacgggcgcggcgacggtgatgtcgtcccagtctatttccgccaggcccgaagtcatcagtaccgcgacgaacagcagggctggcgcggtggcgaaggccgggacgctggccgccagtggcgagaagaacagcgccagaaggaacaggatcgccacgacgatggcggtcaggccggtgcggccaccggcgctgacgcccgcggcggattcgatgtagctggtggtggtcgaggtgcccagcagggaaccggccatggccgcggtgctgtcggcgatcagggcccggcccattttcggcatgtggccgtccttgcccatcaggccggcgcgcttggcgacgccgatcagggtgccggagttgtcgaacaggtcgacgaacaggaaggcgaagatcacgctgaccaggccgatgtccagcgcgcccttgatgtccagttgcaggaaggtcggcgccagggaaggcggcatcgaggtcacgccgccgaacggggtgaagcccagggcgatggagacgatggtcaccgagaggatgccgatcaggaccgcgccgcggactttcagggcttccagggcgacgatcagggcgaagcccagggtcgcgaggatcggtgccggttgcttgaggtcgccgaggccgaccatggtcgccgggttgctgaccacgatgccggcgttgtgcagggcgatcagcgccaggaacaggccgataccggcggcgatcgccgagcgcagcggcagcgggatgctgttgatgatccattcgcggatcttgaagatcgacagcaggaagaacagcaccgccgagatgaacaccgcgcccagcgccacttgccaggtatggcccatgtgcaggaccacggtgtaggtgaagaaggcgttcaggcccatgcccggagccagggcgatcgggtagttggcgatcaggcccatcacggtcgagccgatggcggcggccaggcaggtggcgacgaacaccgcacccttgtccatgccggtctcacccaggatgctcgggttgacgaagagaatgtaggccatggccaggaaggtcgtgaggcccgcgagaatctcggtccgcacattggtgttgtgtgccttgagttgaaacagcctttccagcatgtctgctccccgtggcgcgcagggcgccgtgaatgtatcgacccagacagcaaagcacagaccctgaaaaagcgtccggggattttgtgcgggtcggaaaaagccgcgcatcataccagcagcgcagggctatggctgcgatcctcggcgatgttttgcccgagtggcgactggggcatactgcgccgacgttttggggggacttatgcacagcacgataaaaacgatggccttggcggtagtggccagcagcctgtggttgggcgcggcgccggccatggcccgttccgcgccgcccttgagccaggtggaaatcctcaaggtcgagtcgcagtcctgcggcctggaggatgtgtcggacggacgcgacaagaccgcctgcgatcaccagggcccgaacatcaaggtgtacgtgctggaaatcggctatggccgccagccccgggtggcgctggacggcttcgaggtcaacggcacgcgcgcggcggtctgcgaagagggttccagcctggtgccgtgcggcaactccgggaccaccgtcggctacatctataccttcgacctggccggcaggcaggaagggaccttcaccttcagcaacacctcgctcaacgcgccgggcaacagcatgagcgcgcagatctacatcaagtgacggcagcgtccgaacgcggagggctttaaagctgactaagctttaaagaccctaccgcggacacagcccatgacctttagagccctgattcccctcgccgagggtgtcgacgacctgcaaagcgtgaccctgatcgatgtgctgcgccgtgctcaagtcgaagtgctggtggccagtatcgaagggcggcgcatgctcacttgtgcccgcggcacccggatgaccgccgacggcatgctggtggatgtgctggcccagcacttcgacctgatcgtgctgcccggtggcgccgtcggcgcgcagcacctggcggcccatcaaccgctgatgcaattggtcaaggaccaggccgccgccgggcgcctgttcgccggcatcgccgaagcgccggccctggctttgcagaattacggggtgctgcgccagcggcgcatgacctgcctgcccagcgccagccatcagctgtcgggctgcaacttcgtcgaccagccggtggtggtggatggcaactgcatcaccgcgcaaggctcgggggcggccctgagttttgccctgaccctggtggaacaactgtgcggcaggggtcggcggacggtggtggagggggagttgctggtttagcgatcagcagacatgagcggcaatgggctcgatgcgcggtaacaaggcttgttcggtctgccagatatcgtagtcggcctgtaccgccagccagaccttggctttacctattccggcgcgttccagccttaccgccaattccggccggatcggcgcgtggccgttcagcaccttggagagatgggggcgggcgtagccaagatgcctggccagttccgtcacgctgattcccaactcgggcaatacgtccacacgcagtgtttcaccgggatgtggcgggttgtgcatgggcatgatcctgcctcctgttcagtggtaatccagatagtcgaccagctcgatatccgaacccgtaaaacgaaaaatcactcgccaattgcccgatacggtcagtgaccagtattcgcgacgctcgcccttgagcggatgcaaccgccatcccgggaggtcgaggtcgtcaggctctgtcgcgtgatccatgaaaggcagcatgcgcgccaggcgcctcgcatgatcggctcggatccctcgagtcgatcccgtttcatagaaggccttgaggcctttgtgctgaaaggatttgatcatgcggcgagtgtaaggcgataccttacactcttcctatcggatatgtattgcagcgcgtgaaccggacgatcaacggcgacgtcctgtgaggttcctgcctgcctcgaatcaggccttggcttcttcttccaccggcccatgcatgcgatcgcgacgggccagggtcgggaacagttttatccacaccccggtcaccagcagggtgccgactccaccgaggaccaccgccggcacggtgccgaaccagtgggcggtgagcccggactcgaactcgccgagctggttggaagcgccgataaacaggccattgacggcgctgacccggccacgcatttcgtccggggtttccagctgcacgaaggaggcgcggatcaccatgctgatcatgtccgccgcgcccagcaccaccagcaccgcaagcgaaaaccagaacgaggtcgacaggccgaaggcgatggtggcgacgccgaacacgccgacggcgctgaacatcacccgcccgacatggcggtcgacggcaaagcgcgccagccacagcgacatcagcagtgcccccaccgccggcgccgagcgcagcaggcccaggccccaggcgccggtgagcaggatgtccttggcgaacaccggcagcagcgcggtggcgccgcccagcaatacggcgaacaggtccagggagatcgccccgagaatgtccggccggctgcgaatgaagcgcaccccggcgagcaacgagtcgagggtggccttgcccttgttcagcggcgtctgccgcgcgggcaggttgagcatcaggcagcaggcgatcacatacagcagcacggtcgggccatagacccacacgctgccaaaggcgtagagcaggccgccgagggccggcgcgacgatggtcgccgattgctgggcggactgggccgccgccacggcgcgcgggaataatgcgctgggcacgatgcttggcagcagcgcctgggtggtcggcatctcgaaggagcgggcggcgcccagcaggaacgcgaggatgaagatcatctcgcgagtgacattatgggtggcgctgccgatggccagggacagggcgatcagcgcctgcagcgactggcagatggctgccaccttgcgccggtcatagcggtcggccacatgcccggtgtgcagcatgaacagcacccgcggcgcgaactccaccagcccgaccaggcccaggtcgagcacgttgccggtcagttggtagaggttccagccgatggccacggtgagcatctggaaaccgctggcggtgaagatccgcgccagccagaaagcaatgaacggacggtgatggcgaagcagcagagggtcttggctgggcatctgaaagacaggtctgggcgtggagtagggcgaggttatcaccaagatgtaaccaatagttgcagaatcgttagccctgcatctatcccgtttattcgaaatagcccaatccctgtagccgctgccgcaggctgcgataagggccgaaggaccttcgacggagcagaaatcgccacgaccgttccggtcgatcgcagcctgcggcagcggctacagggagagcaaaacttcggggaaaccccgtgcttgacgtggtgaggcaacctgtcacgcgacaaaagaccacacaaaccaatggcgaaaatgcgactactctttcaacgttgattgatccagatcaaaaccttttccaaggttgggtctggtggccagatggccagactccctgcgttgcgatgggtttaaaaagaacgaattcgaattcgccacactccagatccgtgggggcagtgggtgcaggcctccagccggcagccggtattacctgacagaggaaagcttatgttcggtttggaggcactagatctcgcccgaattcagttcgcgttcaccatctcgttccacatcctgttccccgccatcaccatcggtctggcgagttacctggcggtgctcgaaggtttgtggctcaagacccgcgacgatacctaccgtgacctgtaccacttctggtcgaagatcttcgccgtcaacttcggcatgggggtggtctcgggcctggtcatggcctaccagttcggcaccaactggagtcgcttctccgattttgccggcgccgtcaccgggccgctgctgacctatgaagtgctcaccgcattcttcctcgaagccggtttcctcggggtcatgctgttcggctggaaccgcgtggggcgcggcctgcacttcttctccacggtgatggtggccatcggtacgctgatttcgaccttctggattctctcgtccaacagctggatgcagaccccgcaaggctacgaaatcatcgacggccgcgtgattccggtggactggctggcggtggtgttcaacccgtcgttcccgtaccgcctggcgcatatggccacggcggcctttgtcgccaccgcgttcttcgtcggttcgtccgctgcctggcacctgctgcgcggccgtgacaatccggcgattcgccgcatgctctcgatggcgatgtggatggccctgatcgtcgcgccgatccaggccgtgatcggcgacttccacggcctcaacaccctcaagcaccagccggcgaaaatcgccgcgatcgaagggcactgggaaaacgtcggtaacgagccgaccccgctgatcctgttcggctggccggacatgaaggcagaaaagaccaagttcgccgtcgagatcccgtatctgggcagcctcatcctcactcactcgctggacaagcaggtgccggcgctcaaggagttcccgccgcaagaccggccgaattcgaccatcgtgttctggtcgttccggatcatggtcggcctgggcatgctgatgatcctcaccggcctgtggagcctgtggctgcgcaagcgtgaccgcatctaccagaaccgcgcgttcctgtacctggcattgtggatgggcccatccgggctgatcgcgatcctcgccggctggttcaccaccgagatcggccgccagccgtgggtggtctacgggctgatgcgcaccgcggatgcgtcttctggacatagcctgacgcagatgagcattaccctggcgctgtttgtcgtggtgtatttcgcgctgttcggggcaggcctgggctacatgatgcgcctggtgcgcaaggggccgaagaccaacgaaggcacggaagtcagccacggtggtcctggccagaaacgcacgccggcccgtccgctgtcggccgccgacgacgatgccgaagacaacggcaccagcctgaacaaggggaattaagtcatgggtatcgatcttccgctgatctgggccgtgatcatcatcttcggcatcatgatgtacgtggtcatggacgggttcgacctggggatcgggattctcttcccgttcgtcaaggactcccgcgaccgtgacgtgatgatgaacaccgtcgccccggtctgggacggcaacgaaacctggctggtcctgggcggtgccgcgttgttcggcgccttcccgctggcctattcggtggtgctctcggcgctgtacatgccgctgatcctgatgcttatcgggctgatcttccgcggcgtggccttcgagttccgcttcaaggccaaggaagccaagcgccacatctgggacaaggcgttcatcggcggttcggtggcggcgaccttcttccagggtctggcgctgggcgccttcatcgatggcctgccggtggtcgaccgccagtacgccggcggttcgctggactggttcacgccgttcaccctgttctgcggcggcgcgctggtggtggcctatgccttgctcggctgcacctggctgatcatgaagaccgaaggcaagctgcaggagcagatgcatgacctggcgcggccgctggctttcgtgctgctggcggtgatcggtgtcgtcagtatctggacgccgctggcccacccggaaatcgcctcgcgctggttcaccctgccgaacctgttctggttcctgccggtgccgatcctggtgctggtgaccctgtacggcctgctgcgcgcggtggcccgcaatgctcactacacgccgttcctgctgaccctggtgctgatcttcctcggctacagtggcctgggcatcagcctgtggccgaacatcgtgccgccgtcgatctcgatctgggacgccgccgcgccgccgcaaagccagggcttcatgctggtgggcacgctgttcatcatcccgttcatcctgggttacaccttctggagctactacgtgttccgcggcaaggtcacccacgaagacggctaccactagtcaatgcgccgctccccgtgcgggagcggacctgctcgcgatggcgccccgagcgacgccatcgtctccattccgagaggagtattcgatgatggctggtaaacccacgttgcaggaaatcgaagaagccgagaagaaaccgctctggcagcgcctgggctggctcgccgggatctgggtcggcagcgtgctggcgctgtttatcgtcgccagcctgatgcgcatgttcatgaacgccgcgggcctgaccacacactgattttcaccaccgctcatcccatcccgttgccttgcggcacggttttatagccctcctctggagggctttttttggcctggagttttataagagaaaggggggctggcgatggccgtgcagtcgaccgcgaatggggcggctgccggggggattatttgcgcgccttgaggatcacgaacttgggcgtggcggccacttgctcgacgccgcggaacagccgcgccagcttgctgtgataacccaggtggcggttgccgacgatgtacagcgcgccgcccaccaccagggcttcacgggcctgctggaacatgcgccaggcgaggaagtcgccgaccacctgttgctggtggaagggcgggttgcacagcaccacgtccagcgactgcggttcctggccggccaggccatcgccagcgcgcacggtcacgtcgcgctcgcccagggtcgcgcgccagttctccagggccgattgcacggccatgaaggattcgtccaccagggtgtaatgggcatcggggttgtgcagggcgctggcgatggccagcacgccgttgccgcaccccaggtccgcgacccgggccttgccgaggtttttcggcagatgcgggaggaacgcgcgggtgccgatgtccaggccttcgcggcagaacacgttggcgtggttgagcagctcgatggcgggctcgtcgagcttgtagcgggtcgggtagggcgaaaccaccggggttttcgcctccggggtggcgatcagtaaacgggcttttttcaccgccagcgaagcctgtaccgggccgatatagcgttccagcaggtcgccggcggcccgtggcaggtgcttgaccatcgccgccgccaccacctgggcgcccggggccagttggccttgcaggcggatcagctgttcttccagcagggccagggtcttgggcacgcggatcagtacgcggtcgaacggcccggtcaacggctcgctggccggtaccactgttacggcgtcgaatggccggccattgcgcaccaggtttttctccagcgccagcgcaccgagaaacgagtcgccgctgctgtgcacctgtacgcgcccgaccaggctggccgccagcgcgccgaaactgtcgttgagcaccagcacccgggtgtccgccgtcggctgctgttcggccaggtgattgagcaggtactcgtccgccgcgtcgaaagcttgcaggggctcgttctgttgttcgggctggcggatcaggtcgagctgggcgaaggggctttcgagcaggggcatgggacggactcttggtaatcggtgaatgtcctgccggcgggaggggcgcgatgcgggctggaccgttcgggcaggtggcgcgcaggccacgtggcaggtgcccgaagaggggccaatggtacgtttttttgcgctcgattgcccgcgctctatgccattacaaaccaccggtgtttctgccgcgcgctttgcgggacactaagggcattcgcttattggagcctgccatgactgccagtgcagaaaaatacacgcgccagaccttgctcgacgtccagcccctgactcccagcctgtttaccctgcgcgctacgcgggacgcgggttttcgctttcgcgccgggcaattcgcccggctgggggtgaccaaggccgatggcagcacggtgtggcgcgcgtactccatggtgtcttcgcccttcgacgagtttcttgagttcttctccattgtcgtgcccggcggcgagttcaccagcgagctgagccggctgggggagggcgataccctgatggtggaccggcaggcgttcggttatctgaccctggaccgtttcgtcgatggtcgcgacctctggttgctgtccaccggcaccgggatcgcgccttttgtttcgatcctgcaggacttcgaagtctgggagaaattcgagcggatcatcctggtctacagcgtgcgcgaagccaaggagctggcttatcagcaattgctggccgagctgagggagcgcgattatctggcggaagttgcccacaagctgcaagtcatcaccacggtgacccgtgaacagcatccgggcagcctcaacgggcggatcacccatctgatcgagagcggcgaactggaacgggtcgctggcgtgcccctgagcgccgagcactcgcgagtgatgctctgcggcaacccacagatgatcgacgacacccgcgccttgctcaaacaacgggatatgcacctgagcctgacccggcggcccgggcaggtggcggtggagaactactggtaaaaaaatggcgccgcctgcatgactggcagggggcgccgttttgttgcggcaggagtctcagggcttgttgttctgcgccttgagcaggtcgcggatctcgcccagcagctcttcttccttggtcgggaccggcggcagggttggcgccacggcctcttcgcgcttcaggcggttgatcgccttcacacccatgaagatggcaaaggcaacgatgatgaagtcgatcaggctctggatgaatttgccgtaggccagcgtcacggccggtgtctcgccgacggcgtccttgagcgtgatcgccagatcactgaagtccaccccaccgatcagcaggccgattggcggcatgactacatcaccaacaaacgacgagacgatcttgccgaatgcggcgccgatgataataccgacggccatgtcgaccacattacctttgaccgcgaaggccttgaactcacttagcacgcccataggttattccttgttacagatgaggttggtgaacgcagtgtaattcagcacaaggtatcttgcttgcaacaactgcttacagcgttcgcagttatcgaccgagttaacggcaaatagtttacaaagtgccatcaatcgcgcgcgaaatacccgcgcttgctcttagataccagaatattttttcaatcagactgttgcgacctttctatttagagtttgactctttggtcactagcctctgacaggcgcacctggatgcgttcgattaaaaccagaggaataaaacatgaccatgatcattggccttgggagtttttcccaacgacgcgtattgggcgtactcgccgccagtatgctttctctttccgtacaggccgccactctgacccgcgataacggggccgcggtgggtgataaccagaactcgcagaccgcgggcgctaccggaccggtattgctgcaggatgtgcagttgatccagaaactccagcgtttcgatcgcgagcgcattccagagcgggtggtgcatgcccgtggcaccggtgcccatggttccttcaccgtgaccgacagcctgagcgacctgaccaaggccaaggtattcgccgccggccaggtaacaccggtattcgtgcgtttttccgcggtagtgcatggcaaccactcgccggaaaccctgcgtgacccgcgcggttttgccaccaagttctataccgccgatggtaactgggacctggtcggcaacaacttcccgactttctttattcgcgacgcgatcaaattcccggacatggttcatgcgttcaaacctgacccgcgcaccaacctggatgacgattcccggcgcttcgacttcttctcccatgttccggaagccactcggaccctgaccgagctgtattccaattccggcactccggccagttaccgggaaatggacggtaatggcgtgcacgcctacaagttggtgaatgccaagggcgaagtgcattacgtgaagtttcactggaagagtttgcagggcatcaacaacctcgatcccaaacaagtggtcgaggtgcaggggcgtgattacagccatatgaccaatgacctggtcacgcatatcaacaagggcgacttcccgaaatgggacctgtatgtccaggtcctgaagccggaagatctggccaagttcgatttcgacccgctggatgccaccaaaatctggccgggcgtgcctgagcgcaaggtcgggcagatggtgctcaaccgcaacccggccaacgtgttccaggaaaccgaacaggtggccatggccccggccaacctggtgccgggcatcgagccttcggaagaccgcctgctgcaaggccgggtgttctcctatgccgatacccagctgtaccgcctgggcgccaacgccctgcaattgccgatcaacgcgccgaaagtcgcggtgaacaatggcaaccaggatggcgcgatgaacagcggcagcaccagcaccggcgtgaactaccagccgagccgcctgatgccgcgtgaagagccgcaaagcgcgcgttacagccagttggcgctgagtggcagcacccagcaggcgaagatccagcgcgagcagaacttcaagcaggccggcgatctgtatcgttcgctgagccagaaggagcgtcaggacctggtcgagaacttcggtggctccctggcgaccaccgatgacgagagcaagcacatcatgctgtcgttcctctacaaggccgatccggagtacggcactggcgtgaccaaggtggccaagggcgacctggcccgggtcaaggccctggccgccaagctgtcggattgatcccaccccgcgtcacgcccctggcgtgacgcttcctctttatataggcgcgaggcttgcccgcgaaaggccgcaaagcggccccaataccggtgatggcgttctagctccgggatgaagtcattgcgggcaagcctcgttcctgcgtttttttgtaagggagtcgcacgatgcgcctgttcatttcgctgctgctggccgcctgctcgctgggcgcttatgcgcagcaaccggcccccgcggacccggtggcggtcaaggtccaactagagaattactacttcgatgcggcccgtcgcggcgacgtcgagatgctcaatacctttatcgaggccggttattccctcgatacccaggacgagaagggctataccgccctgatcctcgcggcatatcacggccaggggccggcggtggagcgtttgctggccgccggtgccgacgcctgcgtgcaggataaaagaggcaacacggcgctgatgggcgccattttcaagggcgaagtgaagatcgcccggcgtctgctggccaccgactgcaaccccgaccagcgcaacggcgccggccagacggcggcgatgtacgccgggctgttcaagcgggtggaactgctcgacgccctggcgaccaagggcgccgacctgaatgccgaagattcgctgggcaatagcgccacgcgtctggccgagggcgaaatccgcacggtggcgccgcgctgatccgctccagctgagctatcatcgcggtttttgcccgggggatcagatggccaaggccaagcgcatgtacggctgcaccgagtgcggcgcaacctttcccaaatgggccggccagtgcggcgaatgcggggcctggaacaccctgaccgaaaccatggtggaaagcggcggtgccgcggcccccagtggtcgtaccggctgggccgggcagcaggcgcagatcaagaccctggccgaggtcagcgtcgaagagatcccgcgtttttccacggcttccggcgaactggatcgggtgctcggcggcggcctggtcgacggttcggtggtgctgatcggcggcgacccggggatcggcaagtcgaccattctgttacagaccttgtgcaacatcgccacccgcatgccggcgctctacgtcaccggcgaggaatcgcagcaacaggtggcgatgcgcgcccggcgcctgggcctgccccaggaccagctgcgggtgatgaccgaaacctgtatcgaaaccatcatcgccacggcccggcaggagaagcccaaggtcatggtgatcgactcgatccagaccatcttcaccgagcagctgcaatcggcccccggcggtgtttcccaggtgcgcgaaagcgcggcgctgctggtgcgctacgccaagcagagcggcacggcgatctttctggtgggccacgtgaccaaagagggcgcgctggccgggccgcgggttctcgagcacatggtcgacaccgtgctgtatttcgagggtgaatccgacggccgcctgcgcttgctgcgggcggtgaagaaccgtttcggcgcggtcaacgaactgggcgtgttcggcatgaccgaccgcggcctgaaagaagtttccaatccttcggcaatctttctcacccgtgcccaggaagaagtcccgggcagtgtggtcatggctacctgggaaggcactcggccgatgctggtggaagtccaggcgctggtggatgacagccacctggccaatccgcggcgggtcaccctgggcctggaccagaaccgcctggcgatgctgctggcggtactgcaccgccacggcggcattccgacccacgatcaggacgtgttcctcaacgtcgtcggcggggtcaaggtgctggaaaccgcctccgacctggcgctgatggcggcggtgatgtccagcctgcgcaatcggcccttgccccacgacttgctggtgttcggcgaagtcggcctgtccggcgaagtgcgcccggtgccgagcggccaggagcgcctcaaggaagcggccaagcatggcttcaaacgggccatcgtgcccaagggcaatgccccgaaagagcctccaccgggcctgcggatcattgcggtaacccgtctggagcaggcgctggatgcgctgttcgaatgatcccttactgaaaggaagcagttgatgcggatgacaggagtgggcctcggcgcccttggttttacgctgttgtgggccagcggcctggctgtggccagccaggaagatgcgccgcacggctatcggatcgcccaggaactgctggtcggcgacggcacggtgctcgaggtcctggaagaccggcgcatcaccgcgcaattgcatgcgcagagctggggcagcggcctggacgaggaaactttcgacgagtcgacggacagcgagcaccagccgcagctggaggctcgggtgcgcctggtgtcggaggtcggcgaagtgctggccgagcagcccctgggctacccgctggcgaaggtggagaaggcgccgctcagcggcctgccatacccggcgtttttcctcaccgtcgatcagacggccccaatgggcagctatagcggcccggccacacagatcctggcgccgacgcaaagccgcttggagcccgtactgtatcgggacgaaaacggggagcagcgcccgctggcgatggcccagaccggcaaggcggcctggcagatccttccatcggcatcgggggctaccgagtcgatcgctcaggtgtcttcagcgcctgccagcgagggtgacgattttgtgaccacctaccggatttatcgctgggtggatgggcagtggaccgccaccagtcggcaacagcccggttattgggatatggaaagcgaattccccgagccctcggcgttcccctgagcggctgacgggaagaggcggcgctcaaacctccagcagcgcccccagctcgcgctccagctcctgcggatcggcgagattcagttcgatcagccggcgcagatgttcgatcgactccaggtctatatgcaggcagacgaagcccaactgaccgtgatcgtcgtgcgccagtcgcacgtccatgcgtacttcggcgtcatcgctcaaatggatatcggcttcgaacggctggctttcgtcccccagccagggatcggggcgctggatcagcatgcccctgagcgagagatcgaccaactgcacggaccagcgataaggaccctggctcagttcggtacgggcatcgaaggcgatgcgtttgaaacggcgacgatcggaatggtgttcgctcatgagcagcccccctgcatggtgaaatgactatagacccgggtttgcccaacccgctacagccagcggcgcaccttgcggcaatagtcacggtagcggtcgccgaacaactccagcagatggtgctcgtccggccggatcaccgtcaggttcatcaggtaaatcagcagcggcaacagcagccatggccacaggctgccgagcaacagggcgatggcgcagtaacccagggtgtcgccgagattgatggggttgcgcgagattgcgaacgggccatcgcacagcaggcgccggggttcgccggcattgctggtggtggtgtgccgttgcctgagacgccacatcgcccagaacgacaggccctggccgccgataatcaacagcagggccagggtgcgcagccagccgttgaccgggaccggcaagggcactccgtcggcaagcgacagcgccgccaccaggaacagcagatacagcagcggcggtgacaacggcggtctattgggcggcgcgggcatgggcactccaggcgacgagtcgttaaaggtgcgaccgctttttcgctcgggtggttcagtgcttccgcaaacgcttgcaccgaggcggtgcaaaacctaggaaaaaactcaaaaggacgctctagaccaacgtggggggtggcctttggggccagtagcgctaaactccggatggctgtctttcttgtccaccctggctggaataataaaatgaaaaataataatagcccgctacgccacttaccctggctggtgctggcaatcgtaggagcgtgcgccctcggcgtagtggcattgcgccgcggcgaggcgatcaacgccttgtggatcgtggtcgctgccgtggccatctatctggtcgcataccgttactacagcctgttcatcgctaacaacgtgatgcagctcgatgcgcgccgggccacccccgccgtgctcaacaacgacggtctggactacgttccgaccaacaagcacattcttttcggtcaccacttcgcggccatcgccggcgcgggcccactggtgggtccggtgctggcggcgcagatgggctacctgcccggcacgctctggctgattgccggggtggtgctggcgggggcggtgcaggacttcatggtcctgttcatgtccacccggcgcaacggccgttccctgggcgacatggtccgtgaggaaatgggccggatccccgggaccatcgcgctgttcggctgcttcctgatcatgatcatcatcctcgcggtgctggcgctgatcgtggtcaaggccctggccgaaagcccgtggggcattttcacggtgatggcgaccatcccgatcgcgatgttcatgggcgtctacatgcgctacatccgcccgggccgcatcggtgaaatctccgtcatcggcgtgctcctgctgctgggctcgatctggctggggggccagattgccgcggatccagtgtggtccaaggctttcaccttcaccggcgtacagatcacctggatgctgatcggctacggtttcgtcgccgcggtgctgccggtatggctgatcctggcgcctcgcgactacctgtcgaccttcctcaagatcggtaccatcatcgccctggcgatcggcatcctgatcaccatgcccgagctgaaaatgccggcgctgacccagttcaccgacggcaccggcccggtctggaaaggcggcctgttcccgttcctgttcatcaccatcgcctgtggtgcggtgtccggcttccacgcgctgatctcttccgggaccacgccgaagctgctggataacgaaaccaacgcccgttacatcggttacggcggcatgctgatggagtccttcgtggccatcatggcgatggttgccgcttcggtgatcgagcctggcgtgtacttcgccatgaacagcccggcggccatcgtcggcggtgacgtggtcactgtggcgcagacggtcagcagctggggcttcgccatcactccggacgccctgcaagcggtggccaaggacatcggtgaaaccaccatcctggcccgtgccggcggtgcgccgaccctggcggtcggtatcgcgcagatcctgcacacggtgctgccgggcgagaacaccatggcgttctggtaccacttcgcgatcctgttcgaagcgctgtttatcctgaccgcggtggacgccggtacccgtgccggtcgtttcatgctgcaggacctgctgggttccttcgtgccggcactgaaacgcaccgagtcctggaccgccaacctgatcgccaccgccggctgcgtggccctttggggttacctgctgtaccagggcgtgatcgatccgctgggtggcatcaacaccctgtggccgctgttcggcatctccaaccagatgctggcgggtatcgcgctgatgctcggcaccgtggtgctgatcaagatgaagcgtcaacgctacatctgggtgaccttgctgccagccgcctggctgctgatctgcaccaccaccgcgggcctcatcaagctgttcgacgccaacccggcagtcggtttcctggccctggccaagaagtacagcgatgccctggccaatggtcagatcctcgcgccggccaaggacatcacgcagatgcagcacgtgatcttcaacgcctacaccaacgccacgctgacggtgctgttcctgctggtggtattcagcatcctgttctatgcactcaaggtgggtatttccgcctggggtaaaaaagaacgcacggataaagaatcgccattccatgcactgccagatgcttgatcgaggactgcaatcgtgttcaatgacctgagtcgcctcggtaaatacctcggtcaggccgcgcgcctgatggtcggcatgcccgactacgacaactacgtcgagcatatgcagaccaagcacccggacaagccggtgatgtcgtacgaggcgttcttccgggaacgccaggaagcacggtacggcggcaaagccgggcccaaatgctgttgattcgttagtccctctgtaggagcgagcgtgctcgcgaaaaacgtaaagacgccgagttcattctgaacgcacgcggtgtccttgagttcttcgcgagcaagctcgctcctacagttgtttttgcgttcccattttttcaggagaaccgcttttgtcctctccaatccccgtcaccgttctcagcggcttcctcggcgccggcaagaccaccttgctgcgtcacctgctcaaggccgagcacggcctgaaaatcgccgtgatcgaaaacgaattcagcgacgccggcatcgacacccagttgctgggcgacgagccggtacaagtgatgacgctgtccaatggctgcgtctgctgcaccatccacaccgatctgaccaaggcgctgtacctgttgctggaacggctggacagcggcgagatcgccttcgaccggctggtgatcgaatgcaccgggctggccgaccccgggcccgtggcccagaccttcttcatcgacgaagagctacgcgagcgctatatcctcgacggcatcattaccctggtggacgccaagcacgccgagcaccacctgacccagaccatcgcccaggcccagatcggcttcgccgaccgcctgttggtgagcaagcgcgacctggtggacgagcaaaccttcaatgcactgagcgagcgcctgacccggatcaaccgccgtgcgccgatccgtgtggtcgagcatgggcgcatcgatttggccgaactgctggatgtgcgaggcttcaacctgaatgccgacctgggcggcggtgtcagcctgcgtccggtgagcaaggcgccctccatcgatcgtatttccagcctggtgctgcgcaccgacgcgccgctggatatcgaccgactcagcgagttcatgaacgagctgctggaagaacatggcaagcagctgctgcgctacaagggtgtgctgaacattgccggtgagccacggcgcctggtgttccagggtgtgctcaagttgtacggtttcgactgggataccgaatgggccgaaggcgagacacgggagagcgtgattgtgttcattgccgacgatctgccggaagagaagatccgtgccggattcgcccggatggcggcgcagtaggggcgttgtagtgtctgtactggcgttatcgcgagcaagctcgctcctacatgggggacatggaaaacctgtaggagcgagcttgctcgcgaaacgatctcgggctcagcgtgttatttcgatcctgcactggccttgagcagcctttcctccaggtgatccaggtgcccggtcatcaaggcgaccgcggcctttacgtcaccgtcttcgatggcatcgacaatcgccgcgtgctcctgccaggcgcaatggctgcaggcgcgggtttcatggtgggcaatcgccaatgacgtcagcggcaccaggctgccgaggaaatgcgccagcggcgcgttgccggccacctcggccaattgcaggtggaactcgccggacaggcggatcgccgggccacgcaaaccgcggtcgatacagtcacgttcagcatcgatcagctcccgcagacgcttgaggttacgtggtgccggttgctggcaggcgagcctgaccagggtgatttccgtcaggcggcgggcgtgcaggatctgccgcgtctgttcatggtccggtgctgccacctggggacggtggttgggccgcaggataatcacctgttggtgggacaaacgcgccaggacctggcgaatgatgctgcgactgaccccgaacacttcgccgaggctgtcctcggtgaaccggctggcgggggcgatgcgttgttcgagaatggcatcgaaaatctgcgggtagacatcgtcgaccagcaggttttttctcgccgctgcggcgccgtggcagggcagcggggagggggaatgcaagtttgttcaaggcgtagctggccatggcctgtctccagtccggttaccgatacgaaggtgttggtgcggcttagttgcccagatggtcgtccgggatgttcagctcgatgcccatgcgctggccttccttgaggatgtgccggcgcatttcggcactggccagcgcgctgttcttgttgcggatcgcccggaccaccgcttcattttcttccaggcgttcggccaggtgctccggcgagttgcgcaggatctcagcgctctgcttgagggcgttgctggtctgctgcaccacgttctgaaagatcgggttggaggtcagggtgaacagttcttcgtggaaggcgatgtaggcgttcatcccggcttcgctgtcgttggcgtccagggcctcgcgcatgtccatcagggtcaggcgcaactggcccacttccttgctgctgatggactgtgccaccaggccgacgatgaacggctcgagggtgtagcgcagttgcagcacgtcctcgaggctggcgcccgccacgccactgtccgttgccggttgttcattgaggctggcctccagcaccaccacgcctttgccgggcatggagcgcaccaggcccagggtttccagaacagtcaccgcctcacgcaggctcgggcggctgatgcccagttgctcggccaattcacgttgccccggcagcatgtcgccggagcgccattggccacgggccaaggccgcccgcagcttttctaccactgaatttacaaccgttgacgaggtgatcactgttcactccctggaatatggcggatgaggcccatggcaggcgctgattgttgtgcctgccggcgagaggcacaaggcatgcctcagaactcctgctgctgcgcgccgggcagcggtttgcgcggttggaaaccatagccctgctggccgctcaggactttgttggcccgttggatatcgatgtctttttcccagcgggcgatcgccacggtggcgacgcagttgccgatcaggttggtcagcgcccggccgatgcccatgaaccagtccaccgccagcaccagcaccaggcccaccaccgggatggccgggatcgccgtcagggtggcggccaggattaccagcgccgaaccgggaatcccgtgggcgcctttggaggtgatcagcgataccagcaggatggtcagcaggtcggacatcgacagcggcgtaccggtggcattggcgatgaagacgatggccagggtcaggtagatcgagaacccgtcgaggttgaacgaataacccgtcgggatgaccaggccgactgtggagctgccgatgcccaggtgctccagtttgcgcatgatctgtggcagtacggcgtcggaggaggcggtgccgaggacgatcagcagctcttcgcgcaggtatttgaggaacggcagcatgcgcaggccggaacagcgcatgaccagcccgagaatcaccgccacgaaggcgaagcaggtcaggtagaacaggcccaccaggctgcccaggtgctgcagcgagtccaggccgtatttgctggtggtgaaggcgatggcgccgaacacgccgatcggcgccaggcgcacgatcatgcccatgatgcggaagatgatgtggctgagttcgttgatcagccgcgagatgccggaagcggcttcgcccaccaggttcagcgcgctgccgaacagcacagagaacagcagcacctgcaggatgttgttttcggcgaaggcgcccagtaccgagttggggatcagccccatcaggaactcggaggtgccgtgcatgtgctggctgcgttgggcgatgtcgcccatgtcggcggcggacagctgttccagatggatattggcgccgctgccgatgccagtggtgaaggcgaagaccaggccgatcaccagggcgatggtggtcaggacttcgaagtagatgaccgatttgagcccgatgcgtccgacctttttcaggtcgccggcgccggagatgccgctgaccaccacgcagaagacgatcaggccgatcagcatcttgatcagcttgataaaggcgtcgcccagtggcttgagttgcgaggagtattcggggagtgtcagtccgcacacgatgccgagcatcagtccgaggactacctggaggaaaatcgaacgcgagcaccatctgagcatgaggggaatcctggtcggtgtcccggctgccgtgcgcggagcgcatcagattcgggacttaattattgtggtcttaccggtatgtccagtgcaggcgcagtctatgcccgagtttcccgcgaatacaagggtaaatccgaaaattggcatgaccggtctgaccagtggtgctgattgtgtagccgctgccgaaggctgcgataaggccgaaggccttcttgcgatcttcagagtgtcacggccgtgccggccgatcgcagcctgcggcagcggctacaggtcccgggccaggcaatttgcggacgaaaaaaagcccggcgcgaaggccgggcttttcaggtaacgctctgctaattaagcgccgtataccggcagcttcttgcagatggctttgactttctcacgaacggcgtcgatcaccgcttcgttgttcaggtcggccaggatgtcgcagatccagcccgccagttccttgcactcggcttccttgaagccgcgagtggtcacggccggagtaccgaagcgcaggccggaggtgacgaacggggagcgtgggtcgtttggcacggagttcttgttcacggtgatgaaagccttgcccagagcggcgtcggcgtctttaccggagatttcctgcttgatcagcgacagcaggaacaggtggttctgcgtaccgccggaaaccacgtcgaaaccgcgctcgatgaacacgccggccatggcctgggcgttcttcaccacttgttgctggtaggccttgaattcaggctgcagcgcttccttgaagcagatcgccttggcggcgatcacgtgctccagcgggccgccctgggcacccgggaataccgcggagttcagcttcttctcgatgtcggcgttggcgcgagccaggatcaggccgccacgtggaccgcgcagggtcttgtgggtggtggtggtcacgacgtcggcgaaaggcaccgggttcgggtagacgccagcggcgaccagtcccgcaacgtgagccatatcaacaaagaggtaggcaccgaccttgtcggcgattgcgcggaaacgtgggaagtccaggatctgcgagtaggcagagaaaccggccacgatcattttcggcttgtgctcgaccgccaggcgctcgacttcgtcgtagtcgatcaggccgttggcatcgatgccgtactggatggcgttgtacagcttgccggaggaggaaacgctggcgccgtgggtcaggtgaccgccgtgggccaggctcatgcccaggatggtatcgccagccgacagcagcgccaggtaaacggcggcgttggcttgcgaaccggcgtgcggctggacgttggcgtagtcggcgccgaacagctccttggcacggtcgatggccagctgctcaaccacgtcgacgtattcgcagccgccgtagtaacgcttgcctgggtaaccttcggcgtacttgttggtcagcaccgagccttgagcttccatcaccgcagggctggtgtagttttccgaagcgatcagctcaatgtgctcttcctggcgctgagcttcttgctccatggcggcaaagagatcggcgtcgtacttggcaatagtcaaatcacggctgaacatggcggtcctcaaggatcggggcagaaaaggggggcattctaacccaacgggttttagatggcatatgaaaggacatcatgtcgcagacaagtggtgttcatgagctgcccaggctgagtcctgtagccgctgccgcaggctgcgatcgaccacgcagtggtcgtgctcttgaggccactgaaggccttcggccttatcgcagcctgcggcagcggctacagggaaggcgaggttgatcaatcgaacatgaacagcgcgtcgttgctgaactgcccttcgaagctgttggccggcatcggccggccgaacaggtaaccctggacttcgtcgcagccgtgttcgcgcaggaagtccagttgctcatgggtttccacaccctcggcgatcaccgccaggttcaggctgtgggccatggcgatgatggcgcgggcgatctgcgcgtcctgctcgccggacggcaggccgtcgacgaaggtgcggtcgatcttcaagacatcgatggggaactgcttgaggtagttcagcgatgaataaccggtgccgaagtcgtcgactgcgatgctcaggccgaggttcttcaggccgtcgaggatctgcatcgcctcgctgacttcgcgcatcaggatactttcggtcagttccagctccaggcaggccggcggcaggccggtgtccttgaggatggtggcgatccgcatgcccaactggccatcggagaactgccgggccgagatgttcaccgagaccttcggcacccggaccttggcctggtgccacgccttgagctggcggcaggcttcgctgatgacccagtcgccgacatccaccaccagtcccagttcttcgagcaccgggatgaagtcccccggcggtaccagcccgcgtcgcggatggcgccagcgcagcagggcctcggcgccggtcaggcgcttgccgtcgccgctgaactgcggctggtagtagaggatgaattcctgctgttccagggcatggcgcaggtcgctttccagctccaggcgttccagggcgctggcgttcatgtcggcctggtagaactggaagttgttcttgccgcgctccttggcgtgatacatcgcggtgtcggcgtttttcatcagctggctcagttcgttgccatcctgcgggctcagggcgatgccgatactggcggtgacgaagaactcacggccttcgagcacgaacggcttcaccaggctggcgagaatctgttcggcaacatggatcgcccggttcagggcgatctcgcggctggtccgcggttgcaggagcagggtgaactcatcgccgcccatgcgcgccacggtgtcgtcatcgtcgacgcaatcgagcaggcgggtggccatttccttgagcatgcggtcgcccgcggcgtgccccagggagtcgttgatcggcttgaaacggtccaggtcgaggaacatcagcaccacccaggacttctgccgctccgccgattgcagggcggtgtgcaggcggtcctggaacagcgtacggttgggcaggtgggtcagggcgtcgtagtaggccaggcggtgaatgcgctgctcgctggccttgcgttcgctgatgtcggtgaagaaacacacgtagctggccaggtcgccttcgtcatcgagcaccgcggtgatgccgacccaggccgggtagtgctcgccgttgcgccgcttgagccagacctcgccttcccaggtgctgtgctggtgcaactgcttgagcacatagcgcaggtgggcttcctgttgttcgtcgacggtgagcatgttcggcaactggtcgagcacctgggacaccgcgtagccactgacccggctgaacgcttcgttggcctggacgatgtagcccgccgggtcggtgatcaggatcgccgaggtcgagtgctcgaataccgtggccgccatgcgcaggtctttttccgcgcgacgctgctggctgatatcgcggccgaccccgagcacgccttcgaaagcgccgtgttcgtcccataccagcaccaggcgcaactcgatcggaatcttgcgcccgtcggcccgcaggcagtcgaacaggaacaactgggtctgcacctggttgcgcaatcgcgccagttgctcgggtttgtccagggccttgctgacccgctccatcagggcgtagatgccggtcagttgttgcgggttggcgatggtcgattgccagccgttctggaagatccactccgcgtcataacccagtaccgactgcactgaggggctgacatagttgagggccatcttactgtcggtggagaaaatcacgtcgctgatgctttcggcgagcatgcgatagcgtcgttcgctgtcgcgcagggattcgctggcctcgatctggtcggtgatgtccttggccacgccgatgatgcgcgtgacctggtcgtacttgtcccgcgccagggcctgttcgcggatgtcgaaacagcgccattggccgctgcggtggcgaaagcgcaaatggcactgcagcaactgcaggtagccggcatgccgctgttcctggcgcaggcggtgatagaggtcggcgtcttccgggtgcaggaggatttcccagaaatactcgcccatctggtgcagttcggtcttgttgtagcccagggtctggcccaggtgatggttgctgaaaatcatccgctggctgatgacgtcctgcacatacaggtggtccggcacggtgcgcaccacatccgaccagaaaccctcgcgctccagcagcgacagctcgataagcttgcggctggtgatgtcgctgatgctgaggatcaccgcgcgatagtcggaggggtcttccggcaggcgcaggaccagccacagatgctggtcgtggccctgggcgtcgctgaggcggatttccagctccagctgtttgtgctggttgatcacggtctccagcagttggttgccgatggcgctgctgtggagcgggctgccttcgatcagcagtttccaggcctgctcgcaggagtcgacgttgagcagccgcagggctacctgattgacctcggtgacgcgcagttcttcaagcagcagctggcgctgctgtgggttgtgctccagccaggccttgagctgttcgctgtcgtgcagttgcgccttgtcgagaaacgccggcagcccggagatatccaggacacagagagcgaccccggtgccttcgaaaatatcctgatagcgccgacgcccttcgtgcaactgacgctggcggcggcgcatgttcaacaacgcgattaccggcaacagggaaaacgccagccccagcaggcatttggcgataaacgccggcaacagttgctcgatcaccgcgcgctcgtcgaacaggccgcgcaattgccagtcgctattgcccagtggcgcgaccagcacgctgttggcgatgtcgtcggtgctcaccgcggtgctgctgccgtcgtcgcgactgagggttttctggttcaggcggttttcaatgacccaggtcgggtgaaaaccctggtcggggctgggctgcagggactggacgaaagacggtgccaggcgcagcacccagtaactcttgagggcgccgctgggctggtgcaacagcagctgtaccagcgcgccgttggtggcgttgctgtagtaatagcgctggcctcggctgcggctggtcagctcggcgagccatgcggcgtcctggccgtcggcgccactgtcgctgatgagctggcccttggcatccagcaacgcgatgctttgcaggtcgggcagggacagctgcaaccttttcagcagcagttgttgctgttcggcattctggggcggctcgacgatcggcagcaggttgagggcgatctgcgcattgagtgccaggttgaggctgatgtgctcggccaggtcggcgttgtagtcgatcgcatgttgacgctggtctttgcgggtctgttgcagttggtcgagcagttgccagaacagcagggcgagcagcagcaggaccagggtcgccagcacgcctttcacggtgccgcgcaggggcgagccggacgcaggtgcaggtgcgcgcagggaaaagggcggagtggcattggacaaactgtgatcctgcggtttggctggactggcgcgacgtgcactataagccggacgcccgaagggcggctagcatgccttgagttgtggcaaagtgccagtccgggctggctggaccttgcccggccattgaggtagctttgccggttacgcgggagcgctccagctccagacaatcaggctttttccgtacgcaggcattgatcgcgatcaaatgccggcgccgcgcatggcctggcccgggcttcgcccgctctccattcatcagtcactgacgctaggttcatcatggctcaatacgtcttcaccatgcatcggctgggaaaagttgttccgccgaagcgggaaatcctgaaaaacatctctctgtcgttcttcccgggcgccaagatcggcgtgctgggcctcaacggttcgggtaagtccaccctgctgaaaatcatggccggcgtcgacaccgagttcgagggcgaagcccgtccgatgcccgagctgaacatcggctacctgccccaggagcctcagctggatccgaccaagaccgtgcgtgaagtggtcgaggaagcggtcagcgtgatcaaggacgcccaggcgcgcctggacgaggtctacgcggcctacgccgatccggatgccgacttcgacaagctggccgccgaacaggccaagctcgaagcgatcctgcaggccagcgatggccacaacctggagcgccagctggaagtcgccgccgatgcgctgcgcctgccggcctgggacgccaaggtcgaacacctgtccggtggtgaaaaacgtcgcgtggccctgtgccgcctgctgctgtccgccccggacatgctgctgctcgacgaaccgaccaaccacctggacgccgattccgtggcctggctggaacacttcctccatgatttcccgggcaccgtggttgcgatcacgcacgaccgttacttcctggacaacgtcgccggctggatcctcgagctcgaccgcggtgccggtattccttacgagggcaactattcgggttggctggaagccaagtccgatcgtctggcccaggaatccaagcagcagtcggcccatgaaaaggccatgaaggaagagctggagtgggtgcgcaagggcgccaaggctcgccagtcgaaatccaaggcccgtctggcccgcttcgaagaaatgcaatcgcaggaattccagaagcgcagcgagaccaacgagatctacatcccggccggtccgcgcctgggcgacaaggtcatcgagttcaagaacgtcaccaagggctacggcgatcgcgtgctgatcgacaacctgtcgttctccatgccaaaaggcgccatcgtcggcgtgatcggcggtaacggtgccggtaagtccaccctgttccgcatgctgatgggcaaggaaacgccggactcgggcagcatcgaagtcggcgaaaccgtgcagctggcttgcgtggatcaaagccgcgaagacctggacggcagcaagactgtgttccagcagatctccgacggttccgaccagatccgcatcggcaactacgagatcccgtcgcgtacctacgtcggccgtttcaacttcaagggcggcgaccagcagaagttcgtcaaggacctgtccggtggtgagcgtggccgcctgcacctggccctgaccttgaaagagggcggcaacgtcctgctgctcgacgaaccgtccaacgacctcgacgtcgaaaccctgcgttccctggaagaagccctgctggacttcccgggcgccgccattgtgatctcccacgaccggtggttccttgaccgtgtcgcgacccacatcctggcgtacgaagacgactcgcaagcggtgttcttcgaaggcaactacaccgagtacgaagccgatcgcaagaagcgcctcggcgacgcggcagcccaaccgcaccgcgtgcgttacaagaaactggcctgatcgggccggttgcttgaaagaaacggagccttcgggctccgttttttttgcctgttttttgggttcgccaacatggggcgttgctgatgattaagatcccctgaatggtgcgttaaatgccggaatggcgaaaaatttatatcaattgcaccatttaaattcataactgcgacattttgctctgtcatggtgctgttcgagttgctaaagtcccgggcaaatctgcgttaacgacaataaatttgccgagactttcccatgatcgaatccgtcgaagacttcctcgcccgcctgaaaaagcgcgacccggaccagcctgaattccaccaggcggtggaagaggtgctgcgcagcctgtggccgttcctggaggccaacccgcattacctgacctcgggcattctcgagcgcatctgtgagccggagcgggcggtcgtgtttcgtgtgtcgtgggtcgacgatcagggcaaggtccaggtcaatcgcgggtttcgcatccagatgaacagcgctatcggcccgtacaagggcggtttgcgcttccacccttcggtcaatctgggggtgctgaaattcctcgccttcgagcagaccttcaagaactccctgacttcgctgcccatgggcggcggcaaaggcggctcggacttcgatccgaagggcaagagcgacgccgaggtgatgcgcttctgccaggccttcatgagcgagttgtatcgccatatcggttcggacgtggacgtgccggcgggggatatcggcgtgggcgcccgggaaatcggcttcctgttcggccagtacaagcgcctgagcaatcagttcacttcggtgctgaccggcaagggcatgagttacggcggcagcctgatccgcccggaggctaccggctttggctgcgtgtacttcgccgaagaaatgctcaagcgccgtgacgagcgggtggagggcaagcgcgtggcgatttccggctccggcaacgtggcgcaatacgccgcgcgcaaggtcatggacctgggcggcaaggtgatctccctgtcggactccgaaggcacgctgtactgcgaggccgggctgaccgaggagcaatggcaggcggtgttggaactgaagaacgtcaagcgtgggcgcatcagcgagctggcgacccggttcaacctcgagttccttgccggacagcacccctgggcgctgccgtgcgacatcgcgctgccgtgcgccacccagaacgaactggacgccgagtcggcacgcacgctgctgcgcaatggctgcatgtgcgtggctgaaggggcgaacatgccgaccaccctggaggctgtggatatctttatcgaggccggcattctgttcgccccgggcaaggcgtccaacgccgggggcgtggcggtcagcgggttggagatgtcgcagaacgccatgcgcctgctgtggagcgccggcgaggtggacagcaagctgcacggcatcatgcagtcgatccaccacgcctgcgtgcattacggcgaagaaaacggccggatcaactacgtcaaaggggcgaacatcgccggcttcgtcaaggtcgccgatgccatgctggcccagggcgtggtttaagccgggtcgatgcggatcacctcgatcagttgatcacccgccggccgctgccacagcacttcatcgccaagctgggtgcccagcaacgcccggcccagcggcgagtcccaattgatcaggcccttggcgacatcggcctgatcctctcccaccagttgcacacactgctcggtgccgtgctcgtcggcgaagacgacccggctgccgatctgcactttcgaccgcgatgtcgcctggggaaccacctgggcgctttgcaggcgctggttgaagtagcgcaggtcgcgttcgatatcggccagctgctgtgagtccgcctggtcgcccagcgccgattgttcgttgtgccgggtttgcaggagcgcgaccttggcttgcagttcgctcaggccctgcggggtgacgtagttgggctgcgcgctgatctgccgttccactggttggtcggcctgggcggcagtcagttcctcattgacgaaggctcggctcatgggcgttttcccgtaatggaggtttgggccatggtcgcagccttttggtttcgggccatgcctgaaagcgacttactgtgagcgataagctcgcgcggcgtcgcggtctttttcttcttgccaggcgcgttcgcgttcgtcccagtgacgttcccgataatcgttgcggtcctggttttccagcatggcctggcactggcgaaagccgtcgctccagccctcggcgtattgcgggtccttgaggtagcgcggcacattcttgcgaaattcgccgttgatcgccccggcggcctggcgaccgctggcgcagccatcatcgaagccgtcggcgaaggccggtggataaccctgcttgagcaactgttcgtgggtcgtctcacaaccggtcatcaacgccagcaacgctgccactaccgcataccgccacatctctgactcccacgccgctgaacggctgatagagaaagtctagaaggggattcgtcagtggtctgtgaaagcgcggtaagaatgctaccgggcgtcagtagtggtaccacttcagttccagcatcacctcgtttttcgccgtggccaggtggctgaactcgcgctgggcgctcaggcgcaggcccaggttgcgcgacagctcccattgctggttgaggctcaggctgcggcgcacctcgccattggtgaagtaatcgcccttggcttcgacgctgaagttgcccaacgggtttttccacagcaggccggtgttgaagccggccgccggggtgatgaagccggcgaaatcggcgttgtgctcgacgcgcacggtgcccagggcgaagccgagcatgttctcgctgagctgccaggtgccgccaccgccaccattgacatggctgactagggtttcatcgtcgtgtttgcccggcacccgctccaggccgccggtgacctgccaggaccagggttgcagcagttcgttacgcggcgtcagcgaacgaatggtcgccaggtccagttgctgcagctgccagtggttgccttcgtactggcgcagtttcatttgcaggatttcgatctgtgcgcccaaggggaaaccttcggcgttgtcattgaggtcgtgataggccatgcgcagcccgtattcgccaaaggcctggtcgccgcgggtgcccacgccgacctgccaggtgcgcgattcatggccgtcttccggcaggccagggcgctcgatggacagttcgggcggcgggttgcggttgatcgcccgcaacagctcgaaactgcgctgcgcccgttgcggatcgcgctcctggccgttggcccggtagcgctcaaggcgataggccgcatcgatgatcaacgcctggcggtcccgtggcagggccttgaaggcgggctcctgcaactgttgctggtcggcgctgaccttcagcacccattgctgttcgtcgctgctcagcggcttggcgcgctcgagcagctcacgttcgcgggacgggcggtactcgatcttctccaccaggccggcttccttcaccgccttgacggtgtcggtaggaatcgccgtcaacgggaattgcccggtcaggcgcaggctcggacgggctacttgcagcagctcgagcaagcggtaggagcagttctcgtcgaagaagaagtagtcgaacttgatctgcttcagttcccagacgtgctcgaccatgcgttcggtttcggcctgggtcaggttcagccggtattcccacaggtcgcggttttccaggctgcggtattccgagagcttctcctggtagggcaccagggcgaacaggccgggatagccacccatcaggcctttccaggcatagagaatgctgttgtccgagccttcgatgtaggcgccgaagttgatcgcgtagctgagcagggcggtgtggttgctttgtacgtcggcctggtcgatgcgcagcagggtatggccgaacatcgacgacgggctgttcaggtaggccgccgggaaaatcatcaccgtgctgtggggcgagacgtccttgaaccactggttgaactcattgcagtccaccgccggcagatcgttcaggctcaactgggccttgagccagcgggtgcgggcggggtacacgcattgagcatgctggttgccgctgccggcgggggcgtagagcgcgtcaagggtggccttgagttcggcgtcggggtgttcggcgccgtctttggcgaggaaaaatttcgggtcgctgacataactgcgccagccaccgagcttggcggtttcgtagtggccaagggaaatccagaacggatcgctggccagttgctgcaaacgtgagtggtcgatttgtggcgcggcggacagcggggcgcagacacagagcgccagggaggcaaggcgtttgagcatggtgggcaacttgagtcggaaaaaacaaagacccgggaggggtcatgtccgaaaaacaaaagcccgctcctcgaaaagagcgggcgggtcgagattaagccggggtggcgtacttggccaggcgtgcatcgcttttcagcacggccagggtgttggtgtgcacatcttccgcggtcacgtcggctttgctgaagatctgctggaagtgctcgtgggtgactgcggcgaagtgcgcgcggtcttcaggagcgacgcccaggaccacggcgtaggtggtcagcgcttcgccttcacctttggccatgtcttcggagagctcgttcatcatgccattcatggcaaaccaggatttgccgccgtaagtcagcgcactgttggtcgagcagccgttggtgccggaagtcataccgaaggtcgcgttaccggaggtgccgttggtggtggaggccaggaagtgagccggagtgccgcgctgtccttcgaacagcaggttgccccacccacaatccggaccgcctggcgcttgggccattgcattgatggaaacagcggtgaagagagtaccgagaagaatccgtttcatagctttgttctctttgtgtgcaaaccaatggacaagggttctggcccatgtcggcgccagtgggccggttattagtccagccgcgcagcttggagtttaggcagattccaagggttccgtgtttttttgcatgacattccttgaaatagacggtttttatgctgtctgcgtggggccagggatctgtccgcgctttcgctgcgtcgcgccttgccagccgctgtacccggcgccagaatgccccatctgccccgcctgatgtaaggaagcccgatgcctgatcctgttgctgccagcttgcgtctagcgcccgaagcgctgacccgtccgttttccgctgaacagttcagcttctcgaccaccaatgatttggagccctttcgcggtgtgcttggccaggaacgtgcggtcgaagccttgcagttcggtgtggccatgccacgccccggttacaacgtctttgtcatgggcgagcccggcactggccgcttctctttcgtcaagcgctacctgaaggctgaaggcaaacgtctgcagaccccgtccgactgggtctacgtcaacaatttcgatgagccgcgcgagcctcgcgcgctggagctgccttcgggggccgcgggtgcgttcatcagtgacatcaacggcctgatcgacaatctgctggcgacctttccggcggtcttcgagcatccgtcctatcaacagaagaaaagcgccatcgaccgcgcgttcaaccagcgttacgaccgtgccctcgacgttatcgagcgcctggcgctggagaaggacgtcgcgctgtaccgcgacagcagcaatatcgccttcaccccgatgctcgacggcaaggcgctggacgaggccgagttcgcgcaattgcccgaagccgatcgcgagcgtttccacgaggacatttccgccctggaagagcgcctcaacgaagaactggcgagcctgccgcagtggaagcgcgagtcgagcaaccaactgcgtcacctcaacgaagaaaccatcaccctggccttgcagccgctgctggcgccgctgtccgagaagtacgcggaaaacgccggtgtatgcggctacctgcaagccatgcaggtgtacctgctcaagaccgtggtcgagcaactggtggacgacagcaagaccgacgctgtagcccgcaagctgctggaagaacagtacggcccgagcctggtggtcggccacccggccaatggcggcgcgccggtggtgttcgagccgcacccgacctacgacaacctgtttggccgcatcgaatacagcaccgatcagggcgcgctctacaccacttaccggcagttgcgtccgggtgccctgcatcgggccaacggcggtttcctgattctcgaagccgagaagatgctcagcgaaccctttgtctgggatgccctcaagcgggccctgcaatcgcgcaagctgaagatggagtcgccgctgggcgaactggggcgcctggccaccgtgaccctgaccccgcaacacatcccgttgcaggtcaaggtcgtgatcatcggtgcccgccagctgtactacacgctgcaggacctggatccggacttccaggaaatgtttcgcgtgctggtggacttcgacgaagacatcccgatggtggacgagagcctcgaacagttcgcccagctgctgaaaactcgcacctccgaagaaggcatggcgccgctgactgcggatgcggtggcgcgtctggcgacctacagcgcccggctggcggagcaccaggggcgcttgtcggcgcgtattggcgatctgttccagctggtcagcgaggcggacttcatccgtcacctggcctcggacgagatgaccgatgccgggcacatcgaacgggcactcaaagccaaggccacacgcaccgggcgggtctcggcgcggattctcgatgacatgctggcggggatcatcctgatcgacaccgatggcgctgcggtaggcaagtgcaacggactgaccgtgctggaagtaggcgactcggcctttggcgtgccggcgcggatttccgccacggtctatccgggaggcagcggtatcgtcgacatcgagcgcgaggtcaatctcggccagccgattcactccaagggcgtgatgatcctcaccggctatctgggcagtcgttacgcccaggaattccccctggcgatctcggcgagcatcgcgctggagcaatcctacggttatgtcgatggcgacagtgcgtcgctgggcgaggcgtgcacgctgatctcggccttgtcgaaaaccccgctcaagcaatgctttgccattaccggatcgatcaaccagttcggcgaagtgcaggcggttggcggggtcaacgagaagatcgaaggcttcttccgcctctgcgaagctcggggcctgacgggcgagcaaggtgcgatcattcctcacgccaacgtcgctaccctgatgctcgatgagaaggtgctggcggcggtccgcgccgggcaattccacgtgtatgccgtgcgccaggctgacgaggccctgagcctgctggtcggcgagcccgcgggcgagccggatgcggatggccagttcccggaaggcagcgtcaacgcgcgggtggtggagcgcctgcgggtcatcgctgaaatggtcagcgaggaggacctcaaggaagcggaaaaagagcaggcgcaagaagcattggcgcaaaccaagccggcatgagccttgccgcgacgagggctcggccttcgtcgcggcgccggtccgctggcgtcaactttcgcgaatagaccattcggcgcctgttcagccggtcaactttgcttctcaggcttttcttcctattctcaggcaaggagaacgacagtcgtcactggatcgaaacagtcttcacatgagggctgaataccggatctaccgagggtcgccgccatgtcgcgcaacctctgccttacccgccagtgtcttggcctggtcacccgtatcgagtgcagtatccgcccgctggcgggagataacggaatgtggaccctactgttcgcggccggaatggccggcgagcagccttcggccatcaaggcccagggacctttctgcggtcccagcgtggccgagtccattcttgattccatcgtcgaaagtctgactacccatggttatgagttggccgacgatccgcagatctggtgcctgcaccttcaggcgcaactacggcagatcaatggcgaacgctgccgccattgacgcaatctcccgttaatccctaccgctgagtcctactcggcgggtggtgggttctccagcttgtcgagcttgacctcaaagccatattcgacggtgttgagttcgctgcgctgataggtttccagctcggtgggctgtccatagaagtaatgcacgtcgaacaaggccgggccgtttgccggcgcctcatggctgaccgcaagaatctccttcaggtactggccgctggcgtccttggcatagaaacgccaggcctcggacgggaacaggcgctggtcgacgatcagcgcattgccccgtagctccaggcctttgggcagctggctgacgggcagggctttcttctcgatgctggccaggaacagcgggatcgaaccgacggcgtaagccggggtttccgggaacagggtcaggtcgtaagtgatcgagctgcgcatcggatcgacctcgactgcctccgatggcagttcgatgggctcaccgcgtttgccgttttcgttctgggtgaagaaggtcacggggctgtcgccggtggagaaggacgtgcccagcaactcgtcattgaaggttctcgggtggtcgaactcgatccgcgccgtgctggcgtcctcggtggattgatgaacgaccacgcttttcttcaaggtttcttggtcgaggttggcgcccttgaggtagttcggagcctgatcgtcatacaccactaccggcatgggcaggggctggatcttgctgtcggtggtcagagggtcgaagcgccgcaccggcagattgaggtctttgcgggtgatggtggctccagagaaatccagcacattgacttcgagcttgtcgatcaggccgttgaaatacaccttggtgtaatggctgtgctgctcgcgctcgaaggctttgcgctcatttccaagctgctgctcgaacgcttggctccaggccttctgcttctgcatttcgctgagctgtttggtgtagaaggcgatctgttggctgttttcgttgatcgacccggagcgcgaaaggatctgcccggtagtgtcccgtgcctgcaccagcaatgggttgagcggcgtctcgctgagttcgggcgacagtggggcactgttggtcaactcgatttcggcgctgttcttatccagggacaacagtttcacgctgacattcttgtcgctgcgttgcttgccgatatcggccttgcccagttcgaaggtgaggacctggtgtggcgcgatcacttcggccttgccttgcagcgtcacgggttggggctggttcttgttttcgacttccaggccttcgatgaacgggtaggtcaccgtcaggtcatccgggttggtcaggttggaactggacgggctcaactggatgccgggataggtttccgaccattcgggctggaaggcgatgaccttgccgttgctcagggtcacggactgccattccaggccgtgggggaaggggaattgcgccggcatgttgaagttgaagggaaacaccggctgcaggtcggtcaggtagtcggagttggaggtcttgcgcagtacgaacaggccgttgaggtaggtgtcgaccagtgcctgcgggctggggtagtgcttgagcagggccagggcgtcatcgccgtattcggtctcgatgggcttgttctggagccgcagttgcgcgcgttcgagcagtaacagcgaaccgcccaggtcagcgatggcgtccttgagcttggggtcctggatagcatccagggattgttcgaactgtgcggttttctgttccaggctgacttgctgcttctcgtcgctgggcgagcagccgctgctgagcagtaccgcgatacacaggccggtacccgccaaaggcaatcgcaaatccattctccaggcttcctgtccgatgtcattgagctgttcacgtgcttgcgacactagcagaaaacgctttgacagacgcgcaggtaatggatttcgttgcggtttatgggcttttgggcggctgatatactcgccgccgttttcagacctgtgtgagattcaatggaacgttttatcgagaatgcaatgtacgcctcgcgctggctgctggcgccgatctactttggtctgtcgttggggctgctggccctggccctgaagttcttccaggaagtcttccacgtcattcccaacgtgttcaccatggccgagtccgatctgatcctggtgctgctgtcgttgatcgacatggcgctggtcggtggcctgttggtgatggtgatgatctccggctacgagaacttcgtgtctcagctggacatcgacgaggacaaggaaaagctcaactggctgggcaagatggactcctcctcgctgaagatgaaggtggccgcgtccatcgtggcgatctcctcgatccatctgctgcgggtattcatggatgcgaagaacatcgagccgcagtacctgatgtggtacgtgatcatccacatgaccttcgtgatttcggccttcgccatgggctacctggacaagctgaccaagcactgaccggctgatcaccgctgtagccgcgccgcccggccgttgtgaaacggacgggcggtgtcgtttgtggcttgtgcttttacgggccgaggcatatccctgtaagggtcaagggcttgaactgcgcgaggtgcactcatgaacctgcacgagttgaatgcttatgccgtcgccggaaaaatcgacgagctgaacctgatctccctcgaaggcggcatctatctgctcgaagcgcggatgcatggggcggcctatccgttgagcgacgcccacggtcagatgttgcatctgcgttcggtggagcatgcccgggaagtgctgcacgcctttcccaagctgcccttcaacctgatccatgcctcagtgcatgacgagatgtgtggcctctcggccggtaccgatgacagcctgcgggtgcctctcgccgtccgctcggcctgacaggcgggacgcacgttcatcatcgccatggcatctgtgctagtctgctcgcccttttggttccgggcgtcccgggatgcgctgtgtacgcacggcggatttccgagccgtccgcacagcggagcagtgtcatgtccgaagtaaatctgtccaccgacgaaacccgcgtcagctacggtatcggccgtcagctgggcgaccagctgcgtgacaacccgccaccgggcgtgagcctggacgccatcctggctggcctgaccgacgcgttcgccggcaagcctagccgtgtagaccaggaagaaatgtccgccagcttcaaggtgatccgcgaaatcatgcaggccgaagccgctgccaaggctgaagccgctgctggcgcgggcctggctttcctggctgaaaacgccaagcgtgaaggcatcaccactctggcctccggcctgcagttcgaagtgctgacccagggcgaaggcgccaagccatcccgtgaagacagcgtgcgtacccactaccacggcaccctgatcgacggcactgtgttcgacagctcctacgagcgcggccagcctgcggaattcccagtcggcggcgtgatcgctggctggaccgaggcgctgcaactgatgaatgccggtagcaaatggcgtctgtacgtgccgagcgagctggcttacggcgcgcaaggcgttggcagcatcccgccgcacagcgttctggtatttgacgtcgagctgctcgacgttctgtaagcctcaactgccgggttgagcttgctcgcgatccatacgccgtgtatgcggtgtagggatcgcgagaaggcttgccttggcagaggggtcaggtggggtcatagacgtatttttgcgctcaggccttgcccttcaggtgttccagcagggcgcaaggcccgtgcatagcagaacagaaacaggttgcgcaccagttccttgagtaccactggttcgctggagctcaggccgttgaggtccaggtcgccctgatcctgcagttcgttcaaggcttcttcttccagtaccgcacagacttccccggtttcccgatgcaggattctcaggtaagggtgtgggcggtccagccatgcgtcgatcaaataagtcatgagtctcatctccttgatgggtttcaatgagaataattcttattcaatgaatagcaagtacctattggcgatttctgcttttttctgtgtggaaattgttgtaggtcaaaagggctggccttttgatggtggtggaaaaggcggggaatcaggcgggggcggggagggcttcaccccgtgcctggcacggggcgatagccggaatatcagaccttgcggacgaactcggacttgagcttcatcgggccgataccgtcgatcttgcagtcgatgtcgtggtcgccatcgcacaggcggatgttcttgaccttggtgccgaccttgaccaccagcgaggtgcccttgaccttgaggtccttgatcacggtgatggtgtcgccgtcttgcaggacgttaccgaccgagtcctttttcacggtttcatcggatgcgggctcggcttcgccgttggcggaccattcgtgggcgcattccgggcagaccagttgggcgccatcttcataggtgtattcggaattgcatttcgggcagggtggcaacgtgctcactaagactcctcggattcaggaaggctaaaaaagcgcacattatatagggttttgcccggggaaggggtatcgcgggggatcgagggggaaagcatcatgaacaagcccgctcctgcgcagggcaggagcgggcttgtgtgcaatcggatcttagtgggtgcgggctacggcgaattcgctcagttccaccagcgcgtcgcggtattcgctcggcggcagggcttccaggcaggcaatggcacgggcgacatagtcgcgggccagttgcgcggtgtagtccagggagccggaggcttccacggctgcacggatgctttccaggtcttcgataccgcctttctgaatcgcctggcgcaccagggcagcctgttccggcgtgccttcgcgcatggtgtagatcagcggcagggtcggcttgccttcggccaggtcgtcgccgacgttcttgcccagggtttccgcgtcgccacggtagtcgagcaggtcgtccaccagttggaaggccacgcccaggtgatcgccgaaggtgcgcagggcttcgctctgctcttcggtggcaccggccagggcggcggcgctgtgggtcgaggcctcgaagagcatcgcggtcttgccgcggatgacttccatgtaggtttcttcggtggtgctggcgtcccggactttcgacagctgcagcacttcgccttcggcgatgatgcgggtggcctgcgaaaggatcttcatcaccggcatcgagcccagctcgaccatcatctcgaaggagcgcgagtacaggaagtcgcccaccagcacgctcggggcattgccccacatggcgttggcggtcgagcggccgcggcgcatgccggacatgtcgaccacgtcgtcatgcagcagggtggcggtgtgcaggaattcgatggtggcggccagcaggcgcaggtcgtcgccttcgcgacccagggccttgccacacagcagcaccaataaaggacgcaggcgtttacccccggccgaggtaatgtagtcgccgattttcgataccagcggcactcgggaggtcagctgcttcttgatgatgccgtcgacggcgctaaaatcgtccgccaccgcgcggtagaaagcttggggttgcatcagcgacaggtgctccagaagggttgcgcggcatgctaggacccacgtccggggctgtcaaggcgcgatggacggccccttgcatcgccaagacagcttgcgtacaatcgcgcaccctgaacttcctgggcagcacctgccttacgcaattgcacttgggccgttccagccccatgcagccatgccagccaatacctcttcttataaagagctgggtgagcaggattatcggagaaataccatgtacgcagtaatcgttaccggcggtaagcaatacaaggtcgctgaaggtgaatacctgaagatcgaaaaactggaaatcgccactggcgaatccgtgacttttgaccgcgttctgttggttgccaatggcgacgacgtgaacatcggcgcacctgttgttgctggcgcaaccgtcaaggctgaagtgatctcccaaggtcgtcacgataaagtccgcatcatcaagttccgtcgccgtaagcaccacatgaagcgtatgggccaccgccagtggttcaccgagatcaaaatcaccggtattcaggcttaatttcagcctaattcctcactaggagaattgaactcatggcacacaaaaaagctggtggtagtacccgtaacggtcgcgactcagaagccaaacgccttggcgtgaagatgtatggcggccaggtcatcaaggccggcaacatcatcgtgcgtcagcgcggcacccaattccacgctggctacggcgttggcatgggtaaggatcacaccctcttcgcgaaaatcgaaggcgtgatcaagtttgaagtaaaaggcgccttcggtcgtcgttacgtgagcgtcgtcgcagcttaattgcgcgatcgctggaaaagccctgtctcgcgacggggctttttcgtttgtggggtgagtctcttgcaaaactgtttgtatgggctgccagcgctggatgttacggccgttgatcggggtcgctgcgctcatttttgcaagagtcttatgtcttagtgtttttcggctcgcccgtgcggcgagaggcgttttgttatgaagttcgttgatgaagtttcgatccgagtaaaagctggcgacggcggcaatggctgcatgagtttccgtcgggaaaagttcatcgaaaacggtggtccgaacggtggtgatggtggtgatggcggctcgatctacatgatcgccgacgaaaacctcaataccctggtggactaccgctacacccgccatttcgatgccgagcgcggctccaatggcggcagtaccgattgcaccggcaagaagggtgaggatctcgagctgcgcgtaccggtcggcaccacggtgatcgacgccgggacccaggaagtgatcggtgacctgaccaaggccggccagcgtttgctggtggtgcagggcggttggcacggtctgggtaatacccgtttcaaatccagtaccaaccgtgcgccgcgccagaccacgccgggcaagccgggtgagcagcgtgacctcaagctggagctgaaagtgttggcggacgttggtctgctgggcttgccgaatgccggcaagagcaccttcattcgctcggtgtccgcggccaagccgaaagtggctgactatccgttcacgaccctggtgccgaacctgggcgtggtcagtgtcgaccgctggaagagcttcgtgatcgccgacattccgggtctgatcgaaggcgcttcggatggtgcgggcctgggtatccgtttcctcaagcacctggcgcgtactcgtctgctgctgcatctcgtggacatggcgccactggatgaaagcagtccggccgatgcggcggaagtgatcgtcaatgagctgaccaagttcagtccgtccctggctgagcgcgatcgctggctggtgctgaacaagtgtgaccagatcctcgaggaggagcatgaggcgcgggtcaaggagatcgtcgatcgcctggagtggaccggtccggtgtacgtgatctcggctatttccaaagacggtaccgagcgcctgagtcgcgacatcatgcggtatctggaggatcgtgccgatcgtctggcggccgacccggcctacgccgacgaattggccgagctcgatcagcgtatcgaggacgaggcgcgtgcccagctgcaggctctggacgaccagcgtgccctgcgccgcagcggcgtgaagagcgtgcacgacatcggcgacgatgattgggatgaggaggatgtggatgacgaagatggtccggaaatcatttacgtccgcgactgattcgttgcagtaaactacaagcgccgctcactgagcggcgttttagtatccgggaaacgtagccacgaataactttatgggcgcgctcggtcgcgtggctctcaagctaaggttgaagaagatgcggagtaaggtgacaggtgcgcagcgctgggtcgtgaagatcggcagtgcgctgctgacggcggacggcaaagggctggatcgcgcggcaatgggtgtctgggtcgagcagatggtggccttgcatgaggctggcgtcgagctggtattggtttcctccggcgcggtcgcggccggcatgagccgcctgggctggaccgcacgaccgagtgcgatgcatgagctgcaggcggccgcggccattggccagatgggcctggtgcaggcctgggagtcgagctttgccgagcacggcctgcacactgcgcagattctgctgacccatgacgacctgtccgaccgcaagcgttacctcaacgctcgcagcaccttgcgtgcgctggtcgagctgaaggtgattccggtcatcaatgaaaacgacaccgtggttaccgatgagatccgcttcggcgacaacgacaccctggcggccctggtggccaatctggttgaggctgatctgctggtgattcttacggatcgcgacggcatgttcgatgcggacccccgtaataatcctaatgcccagctgatttacgaggcgcgtgccgacgatccggcgctggatgcggtggcaggcggcacgggtggcgcgctggggcgtggcggtatgcagaccaagctgcgcgcggcgcgtctggcggcccgttccggggcgcacaccatcattgtcggtgggcgtctggagcgtgtgctggatcgcctcaaggcgggtgagcgcctgggtaccttgctgtcgcctgagcgcggcatgctggcggcgcgcaagcaatggctggccgggcacctgcaaacccgaggcaccctggtgttggatgatggtgcggtgtcggccttgtcccggggcaacaaaagtttgctgccggtgggggtcaagctggttcagggcagcttccgtcgtggcgagatggtggtatgcgtggcgccggacgggcgtgaaatcgcccgcggcctggccaactacagcgccctggaagcgcaaaaaatcatcggtcagtcctctgatgcgattgtcggtttgttggggtacatggctgagcccgagctggttcaccgtgacaacctgattctggtctaaggaaaaaccaatgcgtgtagcaaaagggttgttgggattgctgttggcgatgccgctgctggcctgtgctgaagagattggtcaggtgtcgacggtgttcaagtttgtcgggcccaacgatcgcattgtggtcgaagccttcgatgatccgaaggtggagggcgtgacctgctacctgtcgcgcgccaagaccggtggcgtgaagggtgggttgggtctggcggaggatcgcgccgaagcctccattgcctgtcgtcaggtcggcccgattagcttcaagggtgagctcaaggatggcgacgaggtgttcaaagagcgcacttcgctggtgttcaagaccatgcaggtggtgcgtttcctcgacaagaagcgcaataccctggtgtatctggtctatagcgatcggttgatcgagggcagcccgcagaatgcggtgacggcgattccgatcctgccttgggcgcagactccgtaacggtcttcggggctggctcctgcagtggttattccctgtaggggttggcggtcgatgttcgattgctggcgatagcggtttggtggtcaaggtagcaaatcgcagacaataaaaaaccgaccctgaggtcggttttttaacaagcgtgtcgcttaggctgcagcagcaaggttcagagccttgatgtggccattcagacgacctttatggcgagcagctttgttcttgtggatgatgcctttatcggccatgcggtcgataactggcacggccagaacataagcagcttgcgctttttcagcgtcttttgcgtcgatggctttaactacattcttgatgtaggtacgaaccatggaacgcaggctggcgttgtggctgcgacgcttctcagcctgttttgcacgttttttggcggaaggtgagttggccaccgtcgagctcctcgaaagactttttgggaaatagcaaacaaaataggccgcgaatcatgccgatgagttgaagtcttgtcaagggcaggtgatgcgtttcgctgagtggttggatctgaagaggcgggatatttatttccggcgcttgacctgtaaactcgcgagctttggctctgtgctgttgcggcgcggagtatcgcacaagtgggcgcattgttcgcctgctgtttatctacaggcaaaaaacctttccatgaacctgctcaagtcgttggccgctgtcagctctatcaccatgctttcccgggttctggggttcgtgcgcgataccatcattgcgcgcacattcggcgccggaatggcgacggacgcctttttcatcgccttcaagctgcccaacctgctgcgtcgcatctttgccgagggggctttttcccaggcctttgtgccgatcctggcggaatacaaaagccagcagggtgaggaggcgacccgtacctttattgcctatgtgtccggcctgctgaccctggtactggcgctggtgacggcgctagggatcatcgccgcgccctgggtgatctgggcgacggcgccaggttttgtcgacaccccggaaaaattcacgctgaccaccgatctgttgcgcgtgacctttccttatatattgctgatctcgttgtcctccctggcgggggcgatcctcaatacctggaaccgcttttcggtcccggcgttcgtgccgacgttgctgaacgtcgccatgatcgtgttctcggtattccttacgccttatttcgatccgccggtcatggccctgggctgggcggttctggcaggtggcctggcgcagttgctgtatcagctgccgcacctgaaaaagatcggcatgctcgtgctaccgcgcctgaaccttcgcgacaccggggtctggcgggtgctgaagcagatgctgccggccattctcggggtctcggtgagccagatctcgctgatcatcaacaccatcttcgcctcgttcctggtggctggctcggtgtcctggatgtattacgccgatcgcctgatggagctgccttcaggggttctgggggtggcgctgggcacgatcctgctgccgacgctggccaagacttacgccaacaaggatcggcatgaatattcgcggattctcgattggggcctgcgcctgtgcttcatgctggtgctgccttgcgcgctggccctggggattctggcggagccattgacggtgtcgctgttccagtacggccagttcagtgccttcgacgcctcgatgacccagcgtgcgctggtcgcgtattcggtcggtttgctcgcgatcattgtgatcaaggtgctggcgccgggtttctatgcccagcaaaacatccgtaccccggtgaaaatcgctattttcacgctgatcgtcacgcaactgctgaacctggcgttcatcggcccgttgaaacatgcgggcctggcgctggcgatcagcgctggggcctgtatcaacgcgggtttgctgttctatcagctgcgcaagcagcagatgttcttgccgcaacctggctggggcaagtttgcgatcaagctggtcgttgcggtgagcgtgatgtcggcggtgttgctggggctgatgcagttcatgccggcctgggatcaggggaatatgctcgcacgcttcctgcgtctgggtgtgctggtggtggcgggcgtggtggcctatttcggcatgctggcgttgttcggcttccgtctgcgcgacttcaatcgcaaggcgttgcactgaggtcctgaggcacttggacgccggcaaggcagtggttttgtcggttcgatcactttggcgcgtgctgttgcctgtcaccggccgtcgggtgtggttataatcgaccactttatgagcaagaagcgcgttatgcagctggtccgaggcctccacaacctgcgcccccagcatcggggctgtgtcgccactattggcaacttcgacggtgttcaccgtggccaccaggctatcctgggccggctgcgtgagcgtgcgcttgagttgggcgtgcccagctgcgtggtgatattcgagccgcagccgcgcgagttctttgctccggataccgccccggcccgcctggcacgcttgcgcgacaagctgcagctgctggccgaagagggcgtcgaccgggtcctgtgcctggcgttcaaccagcgcttgagcaagctcagcgccagtgagttcgtcgagaccatcctggtcgacggcctgggtgtacagcacctggaagtcggcgatgactttcgttttggctgcgaccgggtcggtgacttcgatttcctgcaaaaggccggtatcacccacggctttaccgtcgaggccgcgcagaccgtcgaactggatggcctgcgcgtcagcagtacccaggttcgcaatgcgctggcggcggccgatttcgtattggccgagcgtctgctcggtcgcccgttccgcatcgccgggcgggtcctgcacgggcagaagctggcgcgccagttgggtacgccaaccatcaatgtgcagctcaagcgccgtcgcgtaccgttgtccggggtgtacctggtcgatgtcgacatcgacggcaagacctggccgggcgtcgccaatatcggcgtgcggccgacggtagcaggtgatggcaaggcccacctggaagtccatcttttagattttgccggcgatctgtatgaccggcgtttgacggtggttttccaccacaagctgcgtgaagagcagcgtttcgcctctctggaggcgctgaagacggcgatcaacgcggatgtcgccgccgcccgtgccgaagttgcacgtatccatagcgccaatcgctaatgaagagccttaaatgaccgactataaagccacgctaaaccttccggacaccgccttcccaatgaaggccggcctgcctcagcgcgaaccgcagattctgcagcgctgggacagcattggcctgtacggtaagttgcgcgaaattggcaaggatcgtccgaagttcgtacttcacgacggtccgccctacgccaacggctcgattcacatcggtcatgcggtcaacaagattctcaaggacatgatcatccgctcgaagaccctggcgggcttcgacgcgccttatgttccgggttgggactgccacggtctgccgatcgagcacaaggtcgaggtcacccacggcaagaacctgtcctcggacaagacccgtgagctgtgccgtgcctacgccaccgagcagatcgaaggccagaaagccgagttcatccgcctcggcgtgctgggcgactgggccaacccgtacaagaccatggacttcgccaacgaggctggggaaatccgtgccctggcggaaatggtcaagggcggttttgtgttcaagggcctcaagccggtgaactggtgcttcgactgcggctcggccctggctgaagcggaagtcgagtaccaggacaagaagtcctcgaccatcgacgtggccttcccgatcgccgacgcagacaagctggccgctgcctttggcctggccaagctgagcaagccggcttcgatcgtgatctggaccaccactccgtggaccatcccggccaaccaggcgttgaacgttcaccctgagttcaactacgccctggtcgacgctggcgacaagctgttggtgctggccgaggagctggtggagtcctgcctggcccgctacaacctggaaggctcggtcatcgccaccgccccgggttcggcgctggagctgatcaacttccgtcacccgttctacgatcgtctgtcgccggtgtacctggctgactacgtcgagctgggcgcgggtaccggcgtggttcactcctcgccagcctacggcgaagacgacttcgcgacctgcaagcgttacggcatggtcaacgacgacatcctcaacccagtgcagagcaatggcgtgtacgccacctcgctggagttcttcggcggccagttcatctggaaggccaacccggccatcgtcgacaagctgactgaagtcggtgcgctgctgcacaccgaaaccatcagccacagctacatgcattgctggcgccacaagaccccgctgatctaccgcgccaccgcgcagtggttcgtcggcatggacaagcagccaaccagcggtaacaccctgcgccagcgtgcgttgcaggccatcgaagagactcagttcgtgccggcctggggccaggcgcgcctgcattcgatgatcgccaaccgtccggactggtgcatctcccgtcagcgcaactggggcgtgccgatcccattcttcctgcacaaggaaagcggcgagctgcacccacgcaccgtcgagttgatggaagaagttgccaagcgtgtcgagcacgaaggcatcgaggcctggttcaagatggacgcggccgagttgctgggtgacgaagccccgcaatacgacaagatcagcgacaccctggacgtctggttcgactccggtaccactcactggcacgtactgcgcggctcgcacccgatgggccacgccagcggcccgcgtgccgacctgtacctggaaggttccgaccagcaccgcggctggttccactcgtccctgctgaccggctgcgcgatcgatggcaatgcgccgtatcgcgaactgctgacccacggtttcaccgtcgacgagaacggtcgcaagatgtccaagtccctgggcaacgtgatcgcgccgcagaaggtcaacgacaccctgggcgccgacatcatgcgcctgtgggtctcggccaccgactattccggtgaaatggcggtttccgaccagatcctgcagcgcagcgccgacgcctaccggcgtatccgcaacaccgcgcgcttcctgctttccaacctgagcggcttcaacccggccaccgatatcctgccggccgaagaaatgctcgccctggaccgttgggccgtggaccgtaccctgctgctgcagcgcgagctggaactgcactacggcgaataccgcttctggaacgtctactccaaggtgcacaacttctgtgtgcaggagctgggcggtttctacctggatatcatcaaggaccgccagtacaccactggcgccgacagcaaggcccgtcgttcgtgccagaccgcgctgttccacatctccgaagcgctggtgcgctggatcgcgccgatcctcgccttcaccgccgacgagctgtggcagtacctgccgggcgagcgcaacgagtcggtgatgctcaacacttggtaccagggcctcagcgagctgccggaaggcttcgagctggaccgtgcctactgggagcggatcatggcggtcaaggtcgcggtcaacaaggaaatggaaatccagcgcgcggccaaggccgtcggtggcaacctgcaagccgaagtgaccctgtacgccgaagaagcgctgagcgccgacctggccaagctgagcaacgaactgcgcttcgtgctgatcacctccaccgccagcgttgcgcctttcgcgcaggcaccggcggatgcggtggaaaccgaagtcgccggcctcaagctgaaagtggtcaagtcgagcttcgccaagtgcgcccgttgctggcactgccgtgaagatgttggcgtgcaccctgagcacccggaaatctgcggtcgctgcgtcgacaacatcagcggcgcaggtgaggttcgtcactatgcctaatgccgcgggccgtttcggccgtctgggctggctgtggttgagtgtgctggtcctggtcatcgaccaggccagcaagctgcacttcgaaagctcgctgtcgatgtaccagcagatcgtggtgattccggattacttcagctggaccctggcctacaacaccggcgcggcattcagcttcctggcggacagctcgggctggcagcgctggttgttcgctctgatcgcggtggtggtcagcgcggtactggtggtctggctcaagcgcctggggcgcaacgaaacctggctggcggtcgccctggcactggtgctgggcggcgcgctgggtaacctgtatgaccgcatcgccctgggccatgtgatcgatttcatcctggtgcattggcagaaccgctggtatttcccggcgttcaactttgccgacagcgccatcagcgtaggtgcggtgatgcttgcgctggatatgttcaaaagcaagaaaaccggagaagccgttcatgactgaacaggtattggctgaacaacgcatcggccagaacacggaagtcactttgcatttcgcattgcgcctggagaacggcgacacggtggacagcaccttcgacaaggccccggcgaccttcaaggtcggtgacggcaacctgttgccaggttttgaagcggccttgttcggtttcaaggcgggggacaagcgtaacctgactatcgagccggaaaacgcctttggccagccgaacccgcaaaacgtgcagatcatcccgcgttcgcagttccaggatatggaactgtccgaaggcctgctggtgatcttcaacgatgcggcgaataccgagctgccaggcgtggtcaaagcttttgatgacgcccaggtgacggttgacttcaaccatccgttggccggtaaaaccttgacctttgatgtcgagatcatcgacgttaaagcgctgtaactaacgaaaccagcctgctgtaggagcgagcttgctcgcgaagttcttcaacgataacgctggcattcaggatgaccgcggcgtctttgagttcttcgcgagcaagctcgctcctacagggcaagacacgaggcacagcatgcaaatcaaactcgccaacccccgtggcttctgcgctggcgtggaccgcgcgatcgaaatcgtcaatcgcgctctggaggtcttcgggccgccgatctacgtgcgtcatgaagtggtgcacaacaaatttgtcgtcgaagacctgcgcgctcgcggcgcgatctttgtcgaggagctggaccaggtgccggatgacgtcatcgtgatcttcagcgcccacggcgtttcccaggccgtgcgcagcgaagcggcgggccgtggcctgaaagtcttcgatgcgacctgcccgctggtgaccaaggtacatatcgaagtggcgcgctacagccgcgacggtcgcgaatgcatcctgatcggccatgccggccacccggaagtcgaaggcaccatgggccagtacgacgccagcaatggcggcgcgatctacctggtggaagacgagcaagacgtcgccgagttgcaggtgcgcaatcctgaaaagctggcgttcgttacccagaccaccttgtcgatggacgacaccagccgggtcatcgatgccttgcgccagcgtttcccggcgattggcgggccgcgcaaggacgacatctgctacgccacgcagaaccgtcaggatgcggtcaagcaactggccgacgagtgcgatgtggtactggtggtgggcagcccgaacagctccaactccaaccgcctgcgtgaactggccgagcgcatggccaccccggcgtacctgatcgacggtgccgaggatatgcaacgcagctggttcgacggcgtcgagcgcatcggcatcaccgccggggcttcggctcccgaggtgctggtacggggcgtgatcgagcagttgcacgcctggggcgctaccggcgccgacgaactggccggccgcgaagaaaacatcaccttttccatgcccaaagagctgcgcgttcgctccctgctctgatcagccctgcctgtcgcataacgcctgcgcggccttgtcgctgcgcaggctgacccgcccactgcgggaaagcaccacctggtgctggctcgttcccggatcggccgcgcagatgtgcagcgtcccggcctgaaaggcgccgctgggcagctgcggatcgcccaggccactgaaacgcacgaaatgctccaccggacgattgccgacaatcgctacccgggcgtccccccggcgttcaagcagtaccgggttatcgctgtcctgcgagccctcgccgctgatatccagaatgatccgccagccttggctccagtcatcgttcaacccgtgaatcacggtccgctgctgacgcaggatggcttcggtgcgcgcattgcgaatgccgctggcaagcatctgtgcggcatccagccggcgtgtcgactggaacaactccccgaatgaggtagtggcgaacagcatcatcaggctggcaagcgccaagcccacgattatttcgatcaggccgaaacccttctgcgacatggttctccctccatggagtgcgtcaggcccggacaatccttgcccggccattgagcaaaacctcaaaccctcggtctatgaaggttcgaagtgccagagccagttatagccgctggccgctcaaggggatggcatgcgtcaccgtacagaaggcttcacgctgatcgaattgctggtggccctggcagttttggcggttttgttgaccctggtggttcccgcgttcagtcagatggcacagcgctccaaggccgacagcgacatcagcgaactgctgcgcagcttgaattacgcgcgtctggaggcgatcgacagcggcttgccggttcacctgcgcccggccgcggtcgattcggactggagccgcgggctgtcgatttatcaaggcgacggaccggcgacgaatgtattgcgggttgttcccgcggtcagtcgcggcgcccggctgacgctaacctctgaattcgacagcattggcttcaacgcgttgggcggtgtatcggctgcggtcccgccggtcatgacttatgtgctgggcgagcaacacaggacgatcacgctgtgcctgaacggacggatagcggtaaacggggagtgcaaatgacgggcaggagcgtgcaggccggaatgacgctgatcgaggtgctggtggcggtgctgattctcggcatcggcctgctcggtgcggcggcggtccagctcaatgccctgcgctacaccgacagtgcattgatgaccagccaggccagcttcatcgcctatgacatgctcgatcgcatccgcgccaacagcgccgcggactacaccgtggcagctcccgaggccggcaatttcggcgtggttcgggaccaggacctctatgacttcaagcgcaatgtcgagagttttggcgggccgaccgccgagggccatatcagcctcaagcagggcgtgttcaccatcagcatcacttgggacgacgcccgtgccgcccatgtttctgcccagcctgctgaaggctcccgcagttttgtcctgagcagccgggtggcggtggatccggggagcaagccatgaatcgcggaaacagcggcttcggcctgatcgaaatgctggtggcgctggcgttgagcctgatcgtggccttgggcgtgacgcagattttcatctcggccaaagacacctatgtcagccagaacgcctcggccagcctgcaagaggatgcgcgcttcgtgctgagcaagatgatccaggaaatacgcatggtcggcatgttcggctgcctgcagagcatcgccgatgccagcattgccgcggacttcgccggtcatgcgcaaacgcctatccgctgggacaacgccaaccaccggctgacgctggtcacggccgatatcggcgacagcggtggcgccccgacctggaccgtgttgagcgattgccgcaatagcgccaccgcctataccggcgcccgcaaggctccctcggggcagcaggcgtttgcggtgcggcgcctggtgtacagcttgaaggacgatcaactgctgatgggcaccggcactggctccggccaggcggtgctggtgaacaatgtcagcgcgttcgacgtgtcgttcggcatcgccagcacggccacggatgtcgcggcctccagctatagccgtgatcctggagacccggcacggatccgtagcgtgcgcttgagcctgaccctgagcgatccccaggcgcgagtgcggccgcagacgttcaatgtggtggccaccttgcgcaatcgcctgttgtgagggagttgccgatgacttcgtatcgaacggctcccggggcgcagcgcggcatggcgctgctgatgagcctggtgttcctgttactgctgaccttgatcggcatttcgtcgatgcagaacgcgaccttgcaggaaaagatggccggcggcctgtggctgcgcaatcaatcgttccaggcggcggagatggcgctgcgcatcggtgagagcgcggtgcagcaggacagttatgtattggcggcctgtagcggcggccagtgcgcgccgcccggcgagtccgcggctgtcagcgccgcgggccacaacggccattcgggcgtgacctggatcgccaccgataacggtttttacgctgtgcagaacctcggtacgacgctgggggcggtccatgtgccgagcaacacttccgcgaccctgtaccgggtgaccgctgtcgggctggccggccactcgcgcagcgtgctggagagcatttatgccaagtattgaaaggcctgggggattgctggctggcgctttgctgggcctctatctgagtgccccggcctatggcttcagcccagcgcaggcacctttggcgaacgcggcggcggtggcaccgaatgtgatgctgctgctcgacgactcgcagagcatgaacagcattgtctatgccccgggtttcgatcccgggctggcgcgggcgccggtcaggccgtgccggatgcaggcgggcgaatgcctggccggagccagtccgagcgcggattcgcttgctctttcaacgctgagccaggcgggctgcgccagcggttatgtcggtttctaccgcgacagtgcccggccacagtgcctcaagctgcctgatcccgcggggaacggccgcacccgctattcggctgcctatttggcttacctgctggccctggccgacagtcgcgaccgggatttcaccgatggctcgattcccgctcaggaccggatgaccctggtgcgtgaggccgccagcaagctggtggctgacaaccgcgcgctgcgcattggcctggcgagcttcaacccaccagcgggcggcgatctggcgccgggtgggcgtatcgtgcgcaccatcagcgatctggcaccggtcagcgaccaggtcagccaggctcaggccgacgctaactaccaggcattgctgtccgccatcggcgggctcagggcctcggccgaggcgccgctggcggaaacctattacgagatcagccgttattttcgggggctgacgccttactacaacagcacgccctctacctatggcagcccgatccagtatcgctgccagcgcaattacggcctggtggtgaccgatggcctgcccagttacgaccacagttttccctcccgtgaaccccagggggcgagcagcctgccagattgggatggggtgcccaatgacggcattaatcctggcggcaacgaggagggcagcagcctgtatctggatgacatcgccaagctggcggtggatatcgacatgcgcgcggcaggcctggatatcgcggggaaaagctgggattcggcgggcttcgcgcagcagcacatgaacacttacaccatcggtctcaacgcgcagtaccccatgctggcggatgcggcgaactatggccggggcaagttctacccggtgaccgacaaggcggggctcgacgccgcactggcctcggccctgggcgaggtttcggcttccgccgcccaggcggggagcgccacggcgggggccgccgggctggccagcggttcgagttatttccaggcgtcttatgaccccgtcgattggcacggcaccatcagggcgtatggcatcagccctgctggtgcgatcgacacccgtacgccgctgtggagcacggactcgaccctggttgccgatgcgtcgccggggatcttccatacctggaacagcgccacccggaccgccgttgccttgcgccatgaccaactgtccggcgcgcagcaggccgcgctcgcccagaacctgctgcccggcaccaccgcggccgatctactggcctggagccaggggagtaaccgggccgggctcaaggtgcgtacccgcctgctgggggacatcgtcaactcgccgctggtcatggcgacgccgaccgcgcaggacgccgccgacctgcagggcgacagcgactacagcgcctacctggcgagcaaggcccaaggcatgaccccgagcctgctggtcaacgccaatgacggcctgctttcgctgatcgaccctgagaatggccggcgccgctacgcctatatgccctccagtgccttgccgctgctgcatcacatcgccgaccccggctacgtcaacggggagcgtcaccggtttttggccgatggcccggtggcggtcttcgatgcccaactcggcacggcctgggcaaccctggcgctggcgggcaccggggccggcggcaaggtgttttatgcggtgcagctgtatggccaggccggcaatacgccgcaggcgctgtgggaaatcgccgcgcctgaggttgccgataacagccacccgttcaatgacctgggttatgcctacgcccgtccggaagtggcacgcttggccgacgggcgctgggcggcctttatcggcaatggttatggcagccattccggggtcgctgccctgtatgtggtggatattcgcgatggctcgttgatcaggaaaatcccggtcgatggcaatgggcaggagaacggcttgtcctcggtgaaggtgcgggtggacagccagaatgtggtccaggcggcctatggcggcgatctccagggccatctgtggaagttcgatttgagcggttcggccccggacagctggggcccggcctttggcggtgctccgttgttcagcgctccgggtggcgcgagccagccgatcaccgcgcagccgttgctggtggatcatcccgagggcggcaagctggtgctgttcggcaccggcaagctcagcgagctggccgacaaacgcagcaaggatgcccagggcttttacgcggtctgggatgccccggctggtacgggcagcatcaccgtggctgacctgcaggcgcaagcgatcaccgggctgtttgccggtagcgcgggctcctatatcaccagcacccaggcggatgtcagttatccggccgagcagggctggtacctgccgctgggggaggcgtccagcggcgagcgggtcatcaatcaggccacgctggtttcgggtcgcattgtcttcagcaccgccgctgtcgaggcgggcgacccttgttcctgcgcgggcaacggcaaattggtcgagctggacgcattcagcggtaagatgcagggcgacgcggtgctcgacaccaatggcgatgaagtggtcgatggcctggacacgccttccagcggtgtcatctttaccggcggcattcctgcgttgagcgctgtccttaaccgcgctacccgcaaaatcgtcagcgattccggcggcggtatcgcctccctggtcgagaagccgggtggtggcagccgccgcatcatgtggcgacaaatacagtaagtgagagtgaggcatgcgtagatccaaccaaggttttaccctgatcgaaatcatgatcgtgattgcgatcatcgggctcgtcgtcaccctgagcctgcccagcatcaccgagtacgtgaagaaaacccatcgcacgcaaatcgccggcctgctgtcggaacaggcgcagagcctcgagcggtttcattccaagggcggtgtctacagcaacgctccgggcctcagcgccggcaacgacgactacagcatcacgccagtcctggccgaccagagctttaccctgaccgcgacgccgaaaaccgagagcatgatggccggcgacaagtgcggcgagttcacccttagccacaccggtgccatgggcaacaacaatatggccgacggggtgaccagcaaggattgctgggggcgctgaacaaccttctcgggcgctagcggcgcccggtgttttcatttcctggactggactatggcaaagcaacagcaagtggtgattgtcggcggtggagtgatcggcctgctgaccgcgttcaacctggcgtccgccgggcagcaggtggtgctgctcgaacgctcgaatgtcggccaggaatcctcctgggccggcggcgggatcgtctcgccgctgtacccttggcgctacagcccggcggtcaccgcgctggcgcattggtcgcaggatttttatccacagctggccgagcgcctgtttgccacgaccggtgtcgatcccgaagtgcacaccaccggcctgtactggctggacctcgacgacgaggccgaagcgctggcctgggcccggcgggaacagcggccattgagcgctgtggatatctcggtggctcatgacgcggtgccggtgctgggcggcggtttttcgcgggcgatctacatggccgacgtggccaacgtgcgcaatccgcgcctggtcaaatcgctgaaggccgccctgtcggccctgccggcggtgacccttcacgaacagtgtgaagtcagcgggtttatccgcgaaggtgagcaagtgctcggggtgcagacctccctgggcgaaatccgtggcgatcaggtggtgctggcggcaggggcctggagcggcgaattgctcaagagcctggggttggcgttgccggtggagccggtcaaaggccagatgatcctctacaagtgcgcctcggactttctttcctgcatggtcctggccaaggggcgttacgcgattccccggcgcgacggccacatcttgatcggcagtaccctggagcatgaaggcttcgacaaaaccccgacctcgtcggccctggaaagcctgaaggcttcggccatcgagttgatcccggcgctggcgcaggccgaggtggtggggcattgggcggggctgcgtccgggttcgcccgagggcattccctatatcggcccggtgccggggctggcggggctgtggttgaactgcgggcactaccgcaacggtctggtcctggcgcccgcgtcctgccagctgttcaccgacctgatgctgggccgggagccgatcatcgacccggcgccttatgcgcccagtgggcgaatttaatccaggccgagtttcttcagccggtagcgcatcgaacgaaacgacaggctcaagcgctgggccgccgccgtgcggttccagcgggtgtgctccagggcctggaggatcagccggcgctcgacttcttgcagatgtttctcaaggttgatcacctgtgccggtccgggcgtgatggccgggtgggcgctgtttggcgtcaggcgcaggtcgcgtgcttcgatccgccggttctcgcacagggtgtgcgcccgttcgagcaggttctccagttcgcgcacgttaccgggaaagtcgtagccctggagcgcttgcagcgcgcttggctgaagccgtgccagttgttggccgttaccctgcgccaggcgctcgagaatggcggtggccaagggttcgatatcagccttgcgcgcccgtagcgctggcaccagcaactcgatcacgttcaggcggtagtagagatcctggcgaaagcgcccggcatgcacttccgccagcaacgccttgtgggtggcgcagagaatgcgtacatcgacctggacctcctgttgcccgccgacgcaacgtaccgccttctcctgcagcgcgcggagcaatttgacctgcatcgccagcggcagatcggccacctcatcgagaaacagcgtgccgccgtgcgccgcctggaacaggccgggcttgtcttcgatagcgccgctgaagctgcctttgcgatggccgaaaaactcgctctccatcagttccggtgggatggctccgcaattgaccggcacgaaggcgtgtctggcccgaggacccaggtcgtggattgcgcgggcgaccagttccttgccgcttccggactctccgctgatatagaccgaggcctggctccgggccagtttgccgatttgttcgcgcagcttgtgcatggcggccgaatcgccgagcaatgggccggtggcagggttcggtggtgtcgatccgggcagggcgccattcagcagctcgcgcaagcgcgccagggccaggggcttgctcaggaagtcgatggcgccggccttcagggcgtggaccgcggtttcctggcgggcgcaggtgctgagtattgccagcggcattcgcagctggcggcactggatatgctcgagtaattccagccccgtgccgtcgggcaaatgcaggtcgctcaggcacaggtcgaagccttcccgggccagccagtgacgcgcttcgcccagggtgcgggcgctgcgggtatggtgttgcatccggccgaggctgatttccagatattcgcgaatgcctggatcgtcatcgacgatcaagactttttgtcgtgggctcatgccgcttactgcttcatccgtgagcgaaagaggtgcgagagcacccgccatcctggcgtgtcgtgaagtctaggcaggcttgaactcgttcgccccactcaaggccgggtggggtgtggtcgtttggtcgggttcaggatgatgcgcagggtaatagccctgatttgccgagggttgccggccggaagtgggacgatgctgaaatggtggattttttgtagcgagttattcagcggtgcaaaccatgtgcttttggcgtcatgtgcaccgctgtcggtcgaggttcagcgatcgcgggagatcggaccttgctccaggtgcgcctggctgcaataccactgctgctcgaggggcagcgcccggtcgcggggcaggtgcacgccgcaatgggcacaacgcaccatgggcgtggtgctgggttcgcggggcgcagcggtgccggaggcgggctgcttgaatttgcgccagagccataccgcagcggcaatcagggcgatccagaacagtagacgaagcatggtagccagctatgtgagtgaggaaccggcagtttagccaagctcatgccgggcgcacagtgcaatcagcgctgaaatccacggacaaaaaagggagactcgaaagtctcccttttttgtgaccgcggcggtgtcagtcgaacacgccgaaggtcatgtagctgaaccacgagcggtcgctgttgttgccttcggcttcatgctgttcttcttcgacagcgtcgccattggcgtctttaggcttgagctctgccggaatcgcatccttggcgtcctggtattgcttcatcacgtcctggttggcgcgggtttctcccggcggcagcggtggacgggactcgatcaggcccagggtggccttgctcagccaggagcggttgtccgcctcggcgacccgtggcacgaactggccgtcgaccagggtcgggtgatcggggtagttaagcttcagggtttccaggctggtggcagccagttcgtccaggtgcagacgctggtaagcctcggtcatcaccgccaggccatcggcgaccgacggggtttcctggaagttttccaccacgtagcggccacggttggcggcggctacataggcctgacgggtcaggtagtagtcggccacgtggatttcgtaggaggccagcaggttgcgcaggtagatcatgcgctgcttggcgtccggcgcgtagcggctgttcgggaaacggctggtgagctgggcgaactcgttgtaggagtcgcgcgcggcacccgggtcacgcttggtcatgtccagcggcaggaagcgcgccagcaggccgacgtcctggtcgaaggaggtcaggcccttgaggtagtaggcgtagtccacgttcgggtgttgtgggtgcaggcggatgaaacgctcggcggcggacttggcggcctccggctcggcgttcttgtagttggcatagatcagttcgagctgtgcctgatccgcgtagcggccgaacggataacgcgactccagggccttgagcttggctgtggcgctggtatagctgttgttgtcgaggtcggtctgcgcctgctggtacagctcgacctcgctcaggttttcgtcaacgacttccttcgatgagcaagcagcggtcagtgcgaggatggcgatcagcagcaggtgtttcacttgcatggcggcttgcgtccctatgacggccgctgtcttgggcggggccgtcctgttatgatgagcgccccgttgaaaagcctcggggcaaaagacgccgtatttaaccacaagcgcgcagccgaaaccaaaggctgtgccgacgcctagtctgagcatgtccgataaaattgaacttcgcgcagaggtgccgtccgaactgggcggccaacgcctcgatcaagtcgccgcccaattattcgctgagcactcgcgctcgcgcctttccgcctggatcaaagacggccgcctgactgtggatggagcggttatccgcccgcgagacatcgtccatggcggcgcggttcttgagctgaccgccgagcaggaagctcagggagaatggatcgctcaggacatcgaactggatatcgtctatgaagacgacgacatcctggtgatcaacaagcctgccggcctggtggtccaccccgccgccggtcacgccgatggcacgctgctcaatgccctgctgcaccatgtcccggacatcatcaacgtgccgcgcgccggcatcgtgcatcgtctggacaaggacaccaccggtctgatggtggtggccaagaccatccaggcgcagacccagctggttgcccagttgcagagccgcagcgtcagccgcatctatgaatgcatcgtgatcggtgtggtcaccgccggcggcaagatcaacgccccgatcggccggcatggccagcaacgccagcgcatggcggtgatggaaggcggcaagccggccgtcagccactaccgcgtgctggagcgtttccgttcccacacccacgtccgggtgaaactggaaaccgggcggacccaccagatccgtgtgcacatggcccatatcaactatccgttggtcggcgatccggcctacggtggccgtttccgcattccgcccgccgcgaacccgaccatggtcgaatccctcaagcacttcccgcgtcaggcgctgcatgcgcggttccttgagctggatcatccgaccaccggcgagcgcatgagctgggaatcgccgctgccggaagatttcgtctggctgctgaccctgctcaagcaggatcgcgaggctttcgtcggatgagtgactggctgattcctgactggcccgcgccggccggggtcaaagcctgcgtcaccacccgtgcgggcggcgtcagcctggcgccgttcgacagcctcaacctgggcgatcatgtcgatgacaacccagaggcggtggccgaaaaccgccgtcgcctgaccgatcgtttctctataaagccagcctggctgaaacaggttcacggtattgatgtggtcgaggcggatccgtccgtcgtcgccaccgccgatgccagctggagcgccacgcccggcattgcctgtagcgccatgaccgccgattgcctgccagcgctgttctgcgaccgtgccggtactcgggtggcagcggcccatgccggttggcgtgggctggcggccggggtgctggaagcgacgctcgatagcctgaaggttgcacctgaggatgtactggtctggctggggccggccattggtccgcaagccttcgaggtcgggccggaagtgcgtgaggctttcgtccggcacttgccacagaccgaacaggcctttgtgccgagccacaatcccggcaaactcatggctgatatctatatgctggctcgcctgcgcctcgcggcatgcggcgtcaccgccgtgtatggtggcggtttctgtaccgtgagcgatgcgcgtttctattcctaccgccgcagcccgcgcaccgggcgcttcgcttccctgatctggctggaacgctagaatcttctgacctgtgtcaagctcgcaaggcttgaatcttccagaatcgaccgcatctacaggggtatctggcaggtttctctatttaggtgtgtttatcgctccgacctgctcaaaaggaaggtgactaatgcgtatagaccgattaaccagcaagcttcagctggcgttatccgattctcaatccctggcggtcggcctcgaccatccggccatcgagccggcgcacttgatgcaggcgctgctcgaacagcagggcggctcgatcaagccgctgctgatgcaagtgggcttcgacgtgaacagcctgcgcaaggaattgagcaaagagctcgaccacttgccgaaaatccagaaccccaccggcgacgtgaacatgtcgcaggatctggctcgcttgctgaaccaggccgatcgcctggcgcaacagaaaggcgaccagttcatctccagcgagttggtgctgctggcggccatggacgaaaacagcaagctcggcaaattgttgctggggcagggcgtcagcaaaaaagcgctggaaaacgccattaataacctgcgaggcggcgaggcggtgaatgacgccaacgtcgaggagtcgcgtcaggccctggataaatacaccgtcgacctgaccaagcgcgccgaagacggcaagctcgacccggtgatcggccgtgacgacgaaatccgccggaccatccaggtgctgcaacgtcggaccaagaacaacccggtgctgatcggtgagcctggcgtgggtaaaaccgcgattgccgaaggcctggcccaacgcatcatcaacggcgaagtgccggatggcctgaagggcaagcgcctgctgtccctggacatgggggcgctgatcgctggcgccaaataccgtggcgagttcgaagagcgcctgaaatccctgctcaacgagctgtccaagcaggaagggcagatcattctgttcatcgacgaactgcacaccatggtcggcgccggtaaaggcgaaggttcgatggatgcgggcaacatgctcaagccagccctggcccggggtgagctgcactgtgtcggcgccaccacgctcaatgagtaccgccaatatatagagaaggacgcggccctcgagcggcgtttccagaaagtcctggtggacgagccgagcgaagaagacaccattgccatcctgcgcggcctgaaagagcgttatgaggtgcaccacaaggtggcgatcaccgatggcgcgatcattgccgcggccaagctcagccatcgctacatcaccgaccggcagttgccggacaaggcgatcgacctgatcgacgaagccgccagccgtatccgcatggagatcgactccaagccggaagtcctggaccgcctggaacggcgcctgattcaactgaaggtcgaatcccaggccctgaagaaagaagacgacgaagcggcgatcaagcgcctggagaaactccaggaggaaatcacccgcctggagcgcgaatacgccgatctggaagaagtctggacctcggagaaagccgaagtgcagggttcggcgcagattcagcagaagatcgagcagtcccgccaggagctggaagccgcgcgccgcaaaggcgacctgaaccgcatggccgagttgcagtacggggtgatcccggacctggagcgcagcctgcagatggtcgaccagcacggccaaagcgagaaccagctgttgcgcagcaaggtgaccgaagaggaaatcgccgaagtcgtgtccaagtggaccggtattccggtatcgaagatgctcgaaggcgagcgtgacaagctgctgaagatggaaagcctgctgcaccagcgtgtcattggccaggacgaagccgtggtggcggtagccaacgcagtgcggcgttctcgcgccgggttgtccgatccgaaccggccaagtggttcgttcatgttcctcggcccgaccggtgtgggtaagaccgaattgtgcaaggcgttggccgaattccttttcgataccgaagaggcgatggtgcggatcgatatgtccgagttcatggagaaacactccgtggctcgattgatcggtgcgcctccaggctacgtcggctacgaggagggcggttacctgaccgaggcggtgcggcgcaagccttattcggtgatcctgctggacgaggtcgagaaggcccatccggacgtgttcaacatcctgctgcaggtgctagaagacggccgcctgacggacagccacgggcgtaccgtggacttccgtaatacggtgatcgtcatgacctccaacctgggctcggcgcagatccaggagctggtgggggatcgcgaagcacagcgggcggcggtgatggatgcggtgtcgacccatttccgtccggagttcatcaaccggatcgacgaagtggtgatcttcgagccattggcccgggatcagatcgccggcatcaccgagatccagctgggacgcctgcgcagccgcctggccgagcgcgagctcaagctggagctgagtggcgaggccttggacaaactgattgccgtgggttacgacccggtctatggcgcgcgtccgctgaagcgggcgatccagcgctggatcgagaacccattggcgcagttgattctgtccggcagtttcctgccgggggccactgtgacggccaaggtggaaaacgacgaaatcgtcttcacctgagcccgatagggcgtcgttgtgaaggaggcctcgcattgcgaggcctttttttgcatagggcgttgaactgtaaggcaaaggcttgtaaagtgcgccccgcagtacgtcgccccaaggctttttcctccctgaggaaaaaactgaaataagttgcaaatcattgtcttgaaagcaatttagggggttgacagaggtttttaagattgtagaatagcgcgcctcagagacatgaacgtagcgatacggaccaagtcgacgaggaggcttctagaaataaaagcctgctgtaaaagttgtaaaattgaaatgttcagttccgtgatagctcagtcggtagagcaaatgactgttaatcattgggtcccaggttcgagtcctggtcacggagccaatttcaagccggggtatagcgcagtccggtagcgcgcctgctttgggagcaggatgtcaggagttcgaatccccttaccccgaccatatttgggtcgttagctcagttggtagagcagttggcttttaaccaattggtcgtaggttcgaatcccacacgacccaccatttttgaaaccagttcgctggaatcgaatcttaagatcagacgccaaaagctctgttcgcagaaggcgcctttaaaaggtgccttttttttaccggggtatagcgcagtccggtagcgcgcctgctttgggagcaggatgtcaggagttcgaatccccttaccccgaccatactgaaaatcctcgtatcgaaagatacggggattttttttgcccggaatttggtgccggttgtgtcttgccggttctgcccaggttcgacagcagctccgcgtcccagaaccctttgtcgaacagcgccaccgagtggtcgggaatctgctgcaaaactcgtcggccaaacgcatttcactgcgtcggtaagggctcattgtgcatccaggatcacatgcgaacgcacgttcatcagcgccaccaggcgcagcataggaaacggtatctgatggtcgcttgcagtgttcccgagccgaagtgatctcaaggctcgggcgtccacaatgcgcagcagcgcaccgtccactacaaagaccggtaggtcatgcctggcatcatcgttatagcgctctacgccccaatggttgcccggtcttgcgcaataaccactcaacaggaccggcgccgagccgtttacgagcttcggttgcctgctgcgagccagcaaatggtcagaagccaggccttgggcgcggatattcaaatgtctggccacctcatgaaccggctcgtcacgaaataacgccacgccgagcacccgccaaagcacttgatcggtgggcagacgctgtcggcgaagggttgcctggctggagagattcagcgcagacgccattcactctatggggatatgtcgcagacgttgaaaaggtcgccgaggtcgagcaggtcctgttgagcagatataaaaaatccgatgccagaagtctggcatcggattttctagaaagcccggcattagctcaaatgcttagctcatgccaattaacctgatgtgggagtgatcgcctgtgtccgtggccagcccctcgttgcgaagggcgtttacggtactcacaagacccggcaaaggccgtccacgcgttcgtaagccagttccttgtttgttggggggagcttgtagtccaccatgcagctgccttcggcccagcgaatctccagccggccctggtcgggaacgccaaagaccagcaggcgcgacaggttgtcgaccatgcccaggggcttgccttgttcgtcgtagccttgggcgccgaaggggattggatcgcccttgtccgcgcgcagcacgaattgcaggcggcgaccggtttgtgcggcataggtggccttgacgatggcgccacgggttggcaccagcaccttggaggtttcgttgatctcggtgtcggtacccagggtctgggtgtccaggttcagccagttgtagcgataaggctgcatatagggcaccaccgcgtaacccttgccattggtgcgaacggcgttccagccggatacaccgacaccgtcgacgtccggaacttccagaaggccgaaagtctcgccaagcggctggccgagggtaacgccaccactgtgcaccagcagcgatccagatgcgcccaggtcgatatgtttgtcgtcacggccctggttatagccaccacgcagcttggcgacgggggtgtcccagtccaggctggcgccggccgtactgccgtttcttttgctgtggcctgcctgtgccgagtagctgagggtcgcctggtcgtccaggtatccggacacgttcgactgcagcgaggaatcgcctttgctcgagctgatggcgttgctggagaggcggtgagaactaccccgacctcccagcggcatgctgacactggcggtgagttgcgtatccgaaccaccgttcatgggatcgctctgggtgcgtgacaccgccaggttgtagctgacgctggcaatgctgctgccataaccaaattgccagttgcgcgtacggccctgctgattccagtagttggtttcatccatgctgaggtacaacgagcctcgttgtgacaggctctggttcacccggaggttgattcggctcttttgggcgctgaagccggcacggtcctgatacatgaggtcgtccacgtgctggctgaagctgcgatagccttcggtggaatagcggtagccagccatggtgaaggtggtatcggtggcgttcagcgtcttggagtacaggaagcgcgcactgtgacccttgttgctcctgccgttctgggtcttcgattcactgctggtgacgtcgaaggaaataccaccgaggctggagttcacgcccgcaccaatgttgacggcgcgatagtcttgcgcgagcagcgcgccgccataaccggtgaggttatcggtcacaccgtagacggctgtgccctgggtgaacgacggcgacggttggtcgttggagcgatattcaccggcggtgacgctgtagcgaaggttgccgcgccgggtcatgaccggctggtaggcataggactgctgatattcgcgtacccggccatctgcttcgatgatcttgatctgcaggtcaccgttggaaccgctgggatagatgtcagtgaactcgaaggcgccaggcggcaccgacgcggaatagatcacgtagccgttttgccgtacttctacagtggcattggattcagcgatgccacggatcacgggcgcgtagccgatctcgttgtcaggcagcataccgaggtccgaagcgatctgtgcaccgcgaaaacgcacgctgtcgaagatctcgcctggggtgtacagctcgcccagggaaagcttgcctttcaggcgccggacatcgcgctccagataggtgcggttgctcttgaactcgctttttgtaccggtaccgccggtcaaggcggattcgttgcgaaagcgccagccggcgatattgaaaccgttgcgcaggttcaggttgtggtagtcgctcttcctgccctggttggtattgcggttgaagttggcctggtagtcgctgtagaaggccgtgatgccgtcgtcccaaaccgatgggtcgacgtaaccgcgggaataacgctggacgtatgcctgcggaatgctgaactgcaatgccaggttggtgacgtcgaagtccaccgcggcgccggcgatctggacgctgacgtcgaacggctgctcatccttggcgtccgcggcgatgagtccatcctgctgggctttgcccgcgttgagtccaagctctttgagcagcccgagcgagatggcgggtttgacctgtccggaggcatcggcggcgaaggtgatttcctggcgcttgatcagcacgttgttcaggtagaggtcaacgctgtaggtgcctggcggaactgcactgcctttctcaaaaaacttgaggtccaccggagtgccctccattttcagaaaggagtcggcgaactcggcctctgcggcggacagcttcgaggccagccccagtgccatgaggcaggtcgcgcacgcccgtcgggcgatcctgaagctgagctctctctgaagaatgggcatgcggaatcctttcgatcgtgcatcggatgtccgaggcactgacctgattaaaaagtcggagataaagcggtgcgctctagcgagcgacacgagtgatggctgttttccgttagttggaaagtttgctggtgactcggtccagcccgccgtaatcgttgatgctgtcgaattccactgttgtggctccggacctcacgccagccgagcctttgatctcgacggtgcgtgttgctcctggtgccagcatttctgcggtggcggtgcccttgtccttgccattgcgcagcgtcacggtgctaccagaaaaggacacgtggtacgcggaagggttggtcacggaaagcgcggctttgccgttttgttccaccagcttccattgcaggctcttggctgcattcgccgcggtgtccggcaggttggccgggcggtagaacagtttcacgcgctgccgtatggcgatctgcagagtgttctcgtccttggctttttgcggaatctcctgcacggccagccagaacacggattccttgtcggtaggcagcccctggccttgatagaggatgcgcaggatctgctgcttgttgcctccaaggcgaaccaggggaggggtaatggcgaacggtacgtcggtcgcgggcccgttggtgtctggctcgacccaggactggaccatgatgtcattcgagccttggttcctgacgacgacggacgtttccttggctggcgcagcgaagatgacgcgtgtgccatccagcgtaatgccggcactggccatcgacgcaaaaagcgtcatcgcgctggcgagcgcaagacgtgtcaatagtgaggctttcatagcggctccaggtcggagggaggggcgcaggcccctccctttggcgcgggttactcgtaagtcaaggtaaacggcagggtgccgttcgcaggacctgctttgatcggcgagccgttcgccacataacctgcacgcaggttcaggttggcggtgtaggtggtggtttcaccttctttgtttgctaccagtgcgccatcgatggtttcgttcgcgccgaggttcaccagcttgttgctgctgttgtaaagaccgatacccacgccttctgcgccaccggtgactttcagcagcgagacgttcttgctgtcgatgccggagccactcatcgggtcgaactgcagcttgacggacttcaggccctctgcggtgccgccgcaatccaggttcaggttgatgcccttaccgccgacgatgccgccttctgcggagccagcgagcgagtcgctgctgaccttgccgaggttgacgtcgatgttctgcttgcccttttcaccaccaacgttggtgccggaaccgccgtcgattttgcaggaggcggcgacgatgtcaccggtgaagttgatagtgccatctgccgcgagagcggaagtgctgaccgcgccagcgatagccatggagatgatgcttttgagaagtttggacatttcatgtacctgctaaagttggaggtgcaatcttgtatcttcactttggtcgttacaataagaccattcttaaactattgattgttctatggctttgaatgatcgctaatacttttttgcctgataagatttcaataagaagattcttaaaatttgatcgggtcacatgaagttgtcggaatacctgtcggcagccaaacggggtgatcgccgcaaaaatcttcgatttttgtatataagcacctgtttttaatgggttaatccttgtgttggtcgggttttagtcgaaggtttaagcgtgcgggacaaactatcaatgcaactagatagagcatgagtggcgtcttgaatactatcgggcccgctatctatatgccgcagtaagaggtggcgcggaggtaggcgtatgtattcggtacgcccggagggagcaacttttggatgtggaggctaagtcaggcggctcttctattttagaattaagactaatcttaaagctgctcggaaagttggaggtggggtgcgggaaatatctaggagcttcgatctttaacagcctgcctgtttgcctgagtccgtgttgaacagggcgcaaaaaaatgccccgatcgctcggggcactctgtcctggtctacaggctcagattcagtgcagcttgaggcgtggctcggtgccgcggccgatccggctgccgagcatcagcatggcggtacggaacgggccgtagagcgccatctggtgcatgcggtacagcgacacatagaacatccgcgccagccagccttcgagcatcacgctgccggtcaggttgcccatcaggttgcccacggcggagaagcgcgacagcgagatcagcgagccgtagtcggtgtatttgtactccggcagggccttgccttcgatacgcagtttcagcgacttggtcagcagcgatgcctgctggtgagccgcctgcgcccgcggtggaacgttgcggtcggtgcccggttgcgggcaggcggcgcagtcgccaaaggcgaagatgttctcgtcgcgggtggtctgcagggtcggcaagacctgcaactggttgatgcggttggtttccaggccgtcgatgtccttgaggaagcccggggcgcgaatgcccgcggcccagactttcaggctggcggcaatcacctggccatcggcggtgatcaggctgtcggcggtgacttcgctgaccgcggcgttggtcatgaccttgaccccgagtttttccagggtcttgtgcaccgggccgccgatccgctccggcagggccggcagtacccgtggcccggcctcgatcagggtgatgtgcatgttttccggcttgatccggtccaggccgtaggccgccagctcatgggcggcattgtgcagttcggcggccagctcgacgcccgtggcgccggcaccgacgatggccacgctgatctgctccaccacatcggtctgcccggcatgggcgcgcaggtagtggttgagcagttgctggtggaagcgttcggcctgtttgcgtgtgtcgaggaacaggcagtgctgggcggcgccctgggtgccgaaatcgttggtggtgctgcccacggcgatcaccagggtgtcgtagcccagctcgcgggccggcagcagctccacgccgttttcgtcgtaggtggcggccagctggatcttcttctgctggcgatcgagcccgctcatgcggcccagctggaactcgaagtggttccatttggcttgggcgacatagttgagttcgtcttcggaagagttcagcgagccggcggccacttcatgcagcaagggtttccagatgtgggtcaggttcgcgtcgaccagcatcacactggcggtaccgcgcttgcccagagtcttacccagacgggtagccaactccagaccgccggcgccgccgccaacgatgacaatacgatgagtcatggggatatctcgcaaggctaaaagaaatcggtacggttacccgagcgagcgcgatgcagctcatagcgtcaggtaactgataagtcggctcagcaggcccaggccaatggtgacgctcacgactatcacgaggagcatccacggccggaagggccggcgctcgactcggtgctgggccagttgcaggtattcttcgacatggcgttggtcgtcggggttcaggcggctggtcataaaaagcctcgtcagctagacgttgcgaaaagtatgaaggttacagcgcagtgccatcttgtcgggctatgcggcaatgaacggagcatagctgctcacggatgccggccttgtcatcccgtgaatgattgcgctttgtaacactcgcgcggtgtttgcgccatgccacgaatggccggcaaggccccgggaaattccgctccagctggcttacaggctgataccgacatcgaagaggatgctgcgccccaggttgccacgcaggaagtccggcgcgtcggggtgggcgaacagcacgcgggcgaaggtcggcccgaccagcgacaacgagcgccagccctggcgcaggtattcggtcggcggcgggaaatggctgttgaggtcgagcacttcgcgcttgaggctggcgaaggcgatgatgtccagctcccccaggtccatgccgcgttccttgtagttgtgggctttcttgcgcagggtcggggccagcctgagcaacagctcgttggctggaatgcgcttgggcttggcctcgcggcgcaccagttggctgagggagaaggcactgcggcgccgttgcaactcgtcgcgccattcgtcgttgaggcggcggccttcgtccagcacgaagaacacctcgaaacaggcctcgcgaaacagtacgtccggcggctcctgcccggcgggcgtgaactcgtcggcacggtaggggatgttcaagccttgcagcaggcgttggcagacccaacgctcacgctcccatttgcgcgcattggacaggaacgcgttggcttgttcggcctgaatggtgagcaggcgcaagtaatctgagtcatccatagtccaagcttagcgtccaaacgctgatccaagaaatacactctgccgggtcggcgggggctgactgcacttataacggataagtgtgacatcaggtcaaccctctgccgctcgttcaggcccgccagggtttcagccagagccccagggcgatcagcaagagcaaaccggccactgtgctgagccccaattgcagccagacattcaacagcggatgcaacagcagcgccgccgcgctcagcaggacggcgctgactgcccagcgcaccggccagttgatcagggtgagcaattgctggcgctgcatcagcaacaggttggtcaggagcacgccgccgagggccgccagaggaattgcggtcagccccagaaccagcggcaggcccgccagcaacaaggcgttgagcaggctgccgagcagttcgcaatgcagtggcgtgctggtatcaccggcggcataggcgtaacgcgcgagcatggcgttccaggcaccaaataccaacgacacggcgaaccagcccagcaacgtcggcagcgggccatcggcgctctgggcgggcagcagccagtggatcagcgccgggctggcacccaccaggccgagcgcggctggcaggctcagcagggtcgcggcgtcgagcccccgatgcagcagccccaggcgctgatcgccggacttgccgctcatcaagccaagcaggacctggttgagactcatcaaggcaatcagcggcaggttgatcagcttgcgcgccaggttgacccaggtcaccacgccttcgcccaggtagctggcgaccagccgttccaccagtgccaggccctggctggccaggttgctggtcaacagcgggccgaggcggccgagcagttcccggccggcaccggcatccccgcggacttgccaggggcgccagccggtttgccagaccgccggcaccagcgacaggcacatcagcaggctgccgaggaaaaatgccagcgaaaggccggaacccaggctcgcctggccgtagaaaaacaggtaaagcaccggtggcaggttgaacagcagcgagcctagccccggcaggacaaaacgttgccgggcgtgcagcgggatgctgaacagcgcgtgcatgagcaggccggggatgcaggcggccaggctgcgcaggttggcggcggcttcggcctgggctgcgctgtcgagcccggggccgatcaggcggatccatagcggcgcgctcaaggccagcagggcatacagccccaggcccaggaccagcaggcgtgggcacaggccggccagccaggcgtgctggcgctgggcgtcgcgttcctgatagagcggcagggccgcggccgcgagaatgccggcggccagggtcatgcgcagggcttcgggaatgaacaccgcgaccaggaacgcatcgctgcggctgcccgcgccccaggccgccaccagcagccattcgcgggcaaaaccggcgagcagcccggcgagggtcgccagggtcagcagcagggtgctgccgagcatcaatagaacagggtgaacaggcctttgccacccaccttgtagttcaggtcgtgagggcgctcgcccatgggtttggcaccgctgccgccgatgatcttgtagggggcaacggccttggccacgagggtgttggcggtcactacggcccctcgaccgatatgcgagccatgggcgagcagcgcccgggtggcgatccaggcgtagtcatcgatgtagatgggcgcggacaccgaccagaactcggggctcatcgggtcatggccgccggcgagaatcagcacgtgggaggcgatcgtcacatgatcgccgatgatcagcccggcccgggcatcgatctggcaatgccaggcgatcacgctgtcatcgccgatcaccaggttttccacccccagcacctcggtgttgcgccagatgctcgagcccttgccgattttcgcgccgcccaggcgcagccaggcgatgcgcacgtgatggctggggatcttgttgatcaggatgttgtaggcctgctcccaggcccgcagccagcggtccttgagggtggccaggttcttgccatagcgcggcaccagggtggtggggatgtcccgcttcaaacggccaaacaggcgtcgggccaggggatgctcgatgatcggttcgatatccaccgcacagatgctgtagcgcgcctgctcgccgtcgccctcgacgaacagcacgtcgttgttcagcccccagctgtaggcctcgagcagttcatcgtggctgacgcccagctccgaggccagggcaggcaggcgttccggcagatccgcagaatggaaaatacgatgtttcatgcttggcgatccttggggttgatgagggggagagtgatggccgggcgcaaccggacctgttgcaggctcatgcccatcaacagccagaacagaccgatcaacacgaaagtgaagctgaagtagtggtcgaacaaacccgtcagcaaggccgccagcaggccggaaatgcaccccagccacaacgcgttgtcggcggtcacctgacggatcggcgccagcgggcgcacctcgcgccaccacaacagggtgacggcgatgaacagcagcatccccggaatgccaatcttgtagatgaagttcagccacaggttggagatgcccggcaggtcggtgcccggtaccggggggtcgaccttgaagccgatgcccagcgggtagcgcatcatcgcctcggggaatttcgcgtactcctcgaaacgcacttcggtactggcgttggtcgccgagaacatggtcatcaggcgttcctgcagcggcgggtagaacatcaccagggccaccgcgaaagccgccccgaggccgatgatccggccactgtagggcacgcgtttgtaggtcagccagatcagcaccagggccagggccaggatcgccccgcgggaaatactcagcagcagccccgcgcaacccaggatcgccaccgccagccccagggcccggcgcgcgccggtgcgggtccagccatagagcagcgccaggggaatgaacagcaccagcacgccgccagtgaggttggggtgaacccagggcgacgccatgcgctggtagttggcggagaagatgtccttcactgcttccgggtgggcgtacttgaggtcggtgaggatcgggatcatcgacatcgcgttgcgcgacttgatgaacatgccgatcgacaacagcagcatcagcagggtgcccagcagcagggcgatcaccagtttgtcgcggtcggcgtcggtacgcagcagcagcggcaccatgaacagcagcgacaggttcatcagccagcgcacccagttcaccgggccgttgccttcggcgtggatgatcagcatgccccagacaaagggaatggcactgaacagcatcagccagaccatggcccgctcggtggggcgccagagcatgaggttgcgggtcttgccgatgaacgattgccagaacagcccgacccacgtcaggccgagtaccgcttcactgaccgtggtgcgaatccccagctgcagcgtggtgtagggaatgcaggtggccagcacggcgaagatcagcaggccccacagcggcttgcggatcagtgtcagggtcacggccaggccgatcaccacgaagatgacttttgccggtggcagggcccacaacagaatcccgaagatcaaccccagggtcaggccaatgaattttcctggcagcatcagtgaaagagccctgtgagcaaggtgtcgaggcgctggcggtgggccggctcggcaaattgccgggcccagtcgcgcagggtatccggatcgggtctgacgctgtcctgcgcctgttcgatcagcgcgttgcgcaggctggcgcgatcgcgggcattgaagcgtcgcgcgccggggggcgtgacctcgtcgagcgccgaacccctggccaccgcgaccggcgtgccctgccacagcgcctcgaccaccggcaggccgaagccttcggcgtaggagggctgccacaggcagtcggcatgccggtacagggcctgcaactgctcgtcgctgacgccattgacccaatgtaggccgggcaactggctcaggttcgcgggcaggtcgctggcatggccgaccaggaccagctccggtacttgcgggttttcctggcggcagcgctgccactgctcgatgaagagcggcatgttcttgcgcggctcccgtgtcccgacggccagccagtaacgctcgggcaggcccgttggcaatgggccgatgacgccctggaattccggcaccaggttgtgcagcacgcggaatttcggccgcgcccagggaaacagccgggccgcttcgctgcaggaaaaccgcgaagggcaccagacctcatcggcaacccagatcgaccaggcgatcgacacggcgtcgatcagccgataggccatggccttgagcggcgagcggtggaagttgcgctgggtcaactggaacaggtcatgcaggatcagcacataacgggtgcccgccggcttgtggccgatgggcaggcccatgttggcggtggcgatatacaggtcgaccgactgctcgcgaatggtcgccggcaagaatttgcgttcgaagcgcaggcgcacgccggggcgttgcacgccatcgagggggctcggccaggccgggcaaaaggcggtctggcgttgttcatgctccagtggcgcttcgctcaccagcagcaattcggtgtcttcacgggcacgcagggcctgttccagtgccttgacctgacgggcgatgcccgaggagggagcgaccgtggccggacgataatcgagggctacacgcatgcgggatgctcctgtgtggagggcagagtccggtagatctgttccagttcgtcaccggccacggcccagtcgtgatgctggcgggcatacaggcgggcggcgccggccagttgggcggcgaggctcggctcgcgcaacaggcgaatcacggcatcggccagggcctgggcattgtcgcctgccaggtaatgttcctcggggcggatggccaggcccgaggcgccctgcgcggtgctgaccagcggcaggccggctgccatggcttcgagcaccttgagcttggagccgccgccctggcgcaacggcgcgatgaacagcgcgcaacgccgttgcaggtcgggcaggtccggcacgaagccgacccattcgatgcggctgtcggcccagcgttcggcccagttgctcggcaaggcatacccggccaccgccaggcgcgcctcggggcaatggctccagacccgcgggaaaatctcatcgagcatccactgcacagcgtccaggttcggcgcgtattcgtagttgccgacaaacagcacccgctggctctgcgggtcggccgagacctcggcaaagctgcggctgtcgacgccgttgaccaccacctcgaccggggtacgggtcagttggcgcatggcccgggcatcgctttcggtcaccgcgaccacctggcgggccgtgtcgaacgccttgcgttcccactgtcggcagcgccattggtcgtagcgcacgaagaggctggcccaggccgggaagcggtcataggtcgcgccgcccaggctggattcgaggttgtgctcggtgagcacgaaatcccgaccggcccgccgcagcggttgcagatagggttgcaggctgtagctgtgttcgacctggatcacatcccagggctcttgcagcaggctgtcgaagcgctcgcgcaaggggcgcgacacgccgttgaccgtggtcagcagcggccacggcgcgaacagcccggccagtaccgtgaccgggtgcttcagcgggcgccggggcaccacgatcaggcgttccagccagggctcgagggcggcgcgggtggcggcatcggcctcggtcttcgactgcaccagcaaggtgatgcggtgcccccgctcgctcaaggtccgcagcaagtgaaactggcgagtcttgcctccactggtcatgggccagggcaggtaggggagaatccagagaatcttcacgtacggcactccaggtcgagatcgattaccacacgagaatctgcagggacgatttcacggccggctggatgccgtccgcggcctcgagactggcccgggttccgctgagcgggtcgtagagctcggcctggtgcacctggggcaagcggatagtgccgcccttggcgctccagaacatcagcaggcgcttaccgtcgtcgcgggtccaggacacgctgtagaaggtgtcgggcaggtttgtaagctctggcgtcttgccgggtttgaggcgcgcgccggtaatctcgagaaaccgcgcgagcgccttgtacaccggcttgggttcgccgttgagatcgagcaggccgtaatgctggtcgcgggccgaggcgcgcgagtcgagatcggaaagggcgaaaagaaagatccgctcgtagtcctggtcgctcatcaacgccaggcgacgcagggtgtagtcggcctggccgtcgacgccgatcagccgctgcatctccttgggtccggcgtagctcgaccagccccactcggtggcccagaccctcttcaggccggcgccgtgcagcatgtcgttgagctgcttgccgcgcagcagcacttcgttcttgcccggctcatcagtttccggggtttccgaatacgggtggtaggcggcgaccatgcccaggctctgcacgcccagttcgccgagtttctcgaacatcagcgcgttgcgctgggtcggcatctggctgtagtaggccatgccgcccatgacctggatcttgtccggcgccacctggttcagcgcctgatgggtcgccagcagcagctcgccgtagcccttggcatcgggtttcggccgccagttgttgggtatgttctgctcgttccacacctgccaggcgtcgatgtccgggtaacgctgggccagcatggccatgcgcgtggcgaagactttcggatcgcgcggcgggtactgatcctggaacggcccgcccttgggggcagtggtcacgaagggcgccgagcctacgaggtagaacagcgacttgagtttcgagtcgctcagggtccggtccagttcgtcgagggtgctgagttgataaccctcttcggtgggttcgagccgatcccaatgcaggtcgacccgcacccattgcaggccgagctgcttataggcggcaatctgtttgcggtattgctgcggggtgaaccacagaaaatgcgcattgacccccaggtaatccttccacaccagggtgcgatcgggggccaggttgatcggcgtggcatcgacctgttcgctgagcagcagggcgccgcccaccgccagcgcggcgaccagtggcagatagcgcaaaagagggcgacgtttaaggcctggtcgggtcttcatttcgatcgctccttgcacacttcattgaacagttcggcgaagcgccgcgcggtcgcgctccactcgcgttgttgcccggcctcgctggcccgcgcggcccactggcgggccagttcgggctccagcaccaggcggctaaggtgctggctcagtgcttcgacatcgccttgctgataggtcacgccattgccgccggcaacctcctcggcaaaggcccgggcattggaggtgacgaccccgcgaccgcaggcattggcccaggacagggcgccgctggtgccgcgcatctggccgagccaggcgagttttttcgattcccggtacggcagcaccatcacatggtgggcctggatggtgcgggcgatctcggcggacggcaggtccagttgccagtccaccacatcgtccagctgcaattcgcgaatgcgctggcgcaggccgtcgaggtagttgccggccgggtcgaaggtcatttccggggcggtgccgccggccagggtcaggcggacctggccacggcactgcgggttggccgccagggtgcgggccagggcctcgatcaggtcctcgatgcccttgccgcggtagatgaagccgaagtacagcaggcgcaacggcaccagcggcggcagttcggccgcggggatcggcaggttgccgtgggcgatcaccgccacctgttgcggtcgcaggcccatgcgctggcgcaggcagtcgccgcccagccgggtcagggttatcagccggcgcatgccgcgggccaggcgccgttcttcgcgcagggtcagcgggtcggcgagcagcgccgcggcttgcggcagcgggtgcggcaggcgttcgagcagggtcagtggccagaacagccgggcgcgccgccagatcaggcgttccgggtcatgcacagtggccgtgcgcgggatccgtggttgttcgctgctcaggtagtcgagcgcctggaactcgccgaagcggccaccgccgagttcggcgtgcaccaggtcgacgcccgtccagtcgaaggcgcgcaggcgcgtcagctgttccgctggatcgtgacagccggccagcggcgtcagcacttcgatgccaaggccgcgcagcgcattgctgaaatgcgcggcgtagtcggcgataccggtctgttccggcggcagcggggccagcaaggcgatacgcatcaggccgcaccgcgccagctgttgatccgttccagcaccctggacggtacttcgaagcggcgacggttgaggatcagcccgtcgaccttgccgaaggcggtagtcagcaacgacagcgcattctcgatcatcggcacggtgctggtccgagcctcgatcaccagggcgatcaggtcggcgcggcgcaggatcaggaaggcctcctggttcgacagcagggccgaggcatccagcagcaggacttcaccgggctgggccggcgcgctgtcgttgacccgcacgcgctggccgcgctcctccagcaggcggcgcaggcgttcgaggatgaaactcacgccttcgccatggcgcgccgaggtcaggcccagggttaggccctggctctcgatgcggtccatgggcaacaggctgtagagccggtagatgctcgcggtcatggcggcgggcgtggcgtcctcgaggtccggcacgctgccccacagcggcacctggaacagctccggcaggcgcgagccgtcgtggatgcgctggtccagcaggtagcagacatagatggtcagcagacccacggcgatgcccgcgggaatggcgaacagcaggatcagcaggctcttggggaagacccgcgccgggttgaaggtggcgtgctcgatgatcgcgatgttgctgatctggctgctgtcgagctcgtggtcgatacgcgcctgttccaggttttccgagtacagcgcgtagctcttttccgcggtgcgcaactgttgggtcaggcggttgagttcaggttcgtcggtcagtacccggtcgcgctcggtacgcagggcagccagggtcttgtcgtagttctcgatctgcccggtcagccggcgctgttgcaactgggcatcgatgacctgctgcttgacgttggtcaccaggctattgggcgcgatgttcttcgagcgttccaggcggctctcttcctgctcgctgagggcctgcaggtcgtggatgttctgttcgatctgcttgaccgccggcgcctcgggcaaataagtgcgcagcaagcgcgcgcgttccacctgcagggtgttgagctggcgcttgaggtcgagctgggttgggttgaggctggtctcgcgactggtcaccacttcgacaggctgatcctggatctgctggcgggcgttgatcaggaagctgctgatcccggacagctggttctgtgcattgacccgggcatcggtcaggcggtcgatctggctcgtgaggttttccaggcgggcatcgacgctgatcgaatcgatctgcttcaggcggctctgcaactgttccttgaggctgaggatctgcgcggccaccttgttgccttcgccttcgtagaaggcatagaggctcttgcgaccgagcacccgggcgcgttcctcgaggaaggtgtcgacccagatcttcaccacctgctgcgcgacttccgggtcgtcccaggtaaagctgatatcgatcaccgacgaacccgcttcgtggctggcctggaagttcttttccaggcgggtcgccaggcggtccagcgggctctgcggctccgacaggccgaccagttgcagcaggctgcgcagcgcatcgatggcggtgcccatggccttcttggcgtagaacttgagggtcttccagaaaccctggggttcggcggccgcgctcagttccaggtagcgctgggcgacgatgtgcacgatgggccggccggtgagcatcttctcctcatcgacgatcgggtcgtgctgggtgctgggcgagatcagcgtctggcgattgccggcttcgatcggcaccgtggtgctgtcgcgcccgggcttgaccagcaggcgcgcgtccgactcgtagcgcgtcggcagcaggaaggcgcccagcaccgcgaccacgatagtggtgatgaccgccagcttgaactcgcggcggaagatgaagaacagacgcaacaggtcgcgtagagagcgtatttcgatcacgggatcactccgttgaaagtacttgtagcagtggctgatggaggccgatcaaacgctgtttactgccccgtcccggtaccggtggaactgctggtgaagttgttgatcgtgttgccgctgttcttcacttcctgatcattcaggtcgtagttgaagcccaggccgatgcccttgttgatcgggaacagcttggtgaagtacatgtccaccgcttccaccgtgctgccgatggtcgattgcggcacgtagatcaggtcgccgcgctgcagggcgaccagcggatggttggggttgctgagcatgttgctgaggtcgacgaagtacatcttgtacttgccgtcgggaccggtcctgagcagggcgatgttggagctgtcggccgacggcagcacgccgccggagctgagcagggcctgttccaccgacacggtgccggcgaggttgaagaacgatggattggccaccgcgccgccgatgaacacccggttgctcggggcaatggcgatgttcacggtcacttcgggctcgcggtagacacgggtgtagcgtttggtgatttccttgcccaggtcttccggggtcagcagcgcggccttgatccggccgatgttgggcatcgagatgaaaccgtccggtcgcaccacgaacatcgtcatgtcgtcggagctggccggctcctgggcatcgcgcacgatgcgcagggtgtcgccactctggatcagcacctgggcgggcggcaggtcggccagggtcagtgccgccgcgtggcgagccttgagggtgtcgctgtcagggagcgcgacatgggcgggggtcgagcagccgcccagccacagggtggcggtcaggatgctcaacagacaaagccgggaaggtcggttaatagtcatcatgacagctcaggtccagtagtttgagaacatgctcaagcgacgcttgagcggtgtcggcagatgctgttcggcgtggccgaggcgatagcccaacagtttcagcgcgctgcgcagcagcacttcgggtacacgttgcaactggccggcgtcacgcaaggcgcgcaactcggcctggacgtaacgcttgccttctccacccgcgctgccaaaggcttcgcggatccagggctcgcggccataaaacacgccgatatcgaaataacggcggaactcctgcatcagactgtagctgtgcgaatgctgtacgcacgcactggcggcgtagcgcaccagataaccgttgagcagcatgcgcgccgcgacgtgggcgtcctcgctgccgatgacatcctcgggaaagccacccaccgcttgcagggcgctgcgccggtagacggaaaacgagtccgaactgaagcaggtcttgatccccagctccccggcgtcggccaggcttttgctgcggctctgggggctgtagttgaagtggcgcgactgcgcctcgagaatcccggccccgggatgcggcagttgacgaccataggcgaggccgatccgtgggtcttcttccagctcctggatcaggttggcgaaggtctggggcgtggccggaatcgcatcctgggtcagcaggatcagcgcgtcggcatccacctgctcgctcgcccagcggcgggtgccgccatggttgaactgctgggcggcgatgacctccacccgggcgccgaactgctggaagcggctgacggtgtcgtccgtcgagctgctgtcgaccaccagcaccgtgtccggctgcagcgtctgcgcggccagcgccgggagcaaccgatcgagatgcggtgcggcgttgcgggcgggaatgatcagcgccaccttcatcatggttttacctgcgccggggcacggccgtagacgtcttcgaaacgcacgatgtcgtcttcgcccaggtactcgccgctttgcacttcgatcatcaccaggtcgatgatcccggggttgctcaggcggtgtttatggccggcggggatataggtggattcgttgctgttgagcaggacctccaggtcgccattggtgatcagggcggcgccgctgaccacgatccagtgctcgctgcggtgatggtgcatctgcagggacagcgactccttgggcttgaccatgatgcgcttgatcttgaagcggctgctttcctccagcacggtgtaggtcccccaagggcgggtgaccgtgcggtgcaggctgtaggcactgtggcccaggcgcttgagttcggtgacgatatggcgcacgtcctgggtccgcgaggcatcggccaccagcagcgcgtccggggtgtcgacgatgatcaggtcgctgacgccgacggccccgagcacccgcttgggcgaatcgatatagcaattgcgcacgtcatgcaggatggcttcgccgttgacctgattgccggcggcatcgctcggggtcagctggcgcagcgcatcccaggagccgatgtcgctccagccgaggtcgcagggcaccacggcgacccgctcggagcgctccatcagggccacgtcgatcgaaacgtccggggcgagggccaggctgtcggcgtcgagttcacgctggcggcagtgcttgttgtccagggtcatgccttgttccaggcaggcctgggcggcgctcagcacctcgggagcatgcagggtcagctcttgcagcagggtatcggcgcggaagcagaacatcccggcgttccacaagtagttgccgctgtcgacgtaggcctgggcggtggccaggttgggtttctcgacgaagcgcgcgacctggaaaccttccttcagcgccgggccctgttcgatgtagccaaaaccggtctcgggtttgtcgggctgaatgccgaaggtcgccagataacctgcttcggcaaggctgcgcgccttgcccacggctgcggcgaaggcatcctggtcgagaatcaggtggtcggccggaaggatcagcaactgcgcctcgtcgccccagtactcgcgcacatgcagggccgccacggcgatggccacggcggtgttgcgcccgaacggctcgagcagcaggtcgaggcccagcttgccctgattgacgttgcggtactcgtccagcgagcggaacagcagctcgcggttggtcaccgtgaccacgcagctgacgtccgccaggctgctggcgcggacgaaggtcttttgcagcaggctctgcccatcgcgcatgcgtatgaatggcttgggcatgttctgccgagagacgggccacaggcgcgagccggagccgccggaaataatgcaggggatcaatccagtgaatgcgctcatcagtagacttccttcgtcgagaggacggccggaaccgtcatgaaaacgatgtacagatccagccagaccgaccacttggagatgtaatcgaggtcgtactccactcgtttctggattttctgcagggtgtcggtttctccccggtagccattgatctgcgcccagccggtgatcccgggcttgacccgatggcgcgagctgtattcgcgcaccgcctgttcgaacggcactcccgccgccttggtggcggtggcgtgtgggcgaggcccgacaatcgacatgttgcccatcagcacgttgaacagctggggcagctcatcgatgctggtcttgcgaatgaagcgtccgacccgggtgatccgcgggtcttcccgggtggtctgccgttcggcgttgaggtccgcttgctcgacatacatcgagcggaacttgaacacgcggatcagccggtcgttgtagccgtagcgcttttgccggaacagcacggggcccttggaatcgagtttcaccgccacggcagtgaccagcagcacaggggacaacaggaccaggcccagcagggcgagcacgatgtcctcgcagcgcttgatcagcggcgcccagccgcgcaatggcagctcggacgtgttgaacatcaggatgccgccgacatcggtcatgcggttgtggccaaagcgcagggtggtgatgtcgggcaccagggcgacattcaccgacaactgccgcagccgttgcaccagctcgccgatgcgcgcgtgcgcggcccagggcagggcgatcaggacctgattgacctgctcggaacggatcagctcttccaggttctgggtgttgcccagaaagggcaggtcgcagaaggccttgggcacgcggtcgctgcgatcgtcgatgaaaccgatcaggccggagcggatatcgccgtggcgctgcatgtgttcggcaaggaacagcgcgctctcgctgaagccgaggatcaccgtgcgttgcaggtatttgcccctggccatccacgaatggaacaggcgcagcagaaacagacgctcgatgccaaacagcacgaggctggcgatgaaccagacagccaggtcccgcaggctgaagaccggcagcaggtgcagccccaggtacatgaccagcaggatgcagaaggcggaggtccaggccaccagcatcgtgcgcaggcgcaggcgattgctgaagaactcttcggagtagaccccctgggcctggaacaggatgacggtgatgacggcaaagaacagcagcaggccaagtacggttggccagatatccgcgctggcggattcaagactcaggagcagcaggattccaggcagggcggcggacagggcgtgcgtcagttttacccccgaaatgaagagttccatgaatccggttcgggtcaggaacctgctatcaatcgatttcgtaagcatcgaatcccgtcgttgccaggtaaagacccagctctgttaagggtaaagccactacagaggcaggctgaaaaactaaggcttactgcaaaaaagtctgttttttggcggcctgtgatggccaaacaatactatttttctgctttgatggtcaactaattgactaattctggcaggttaaccttttttttgcattatgcatcggttttttgacggtttggcgcatccaggacgaatggaagcctgggcgtgtgtcacgaagttggctcattcgtgagcgagggcgtgacggataaatggagtgttgttcaggggtcgactcttgtccaaccggtggcgatttattccctttcgcccatgattgcggggttcttgatggctggcgcggccctcgggcgaggcgctctggcggtgtagactggacgctgcgaactcaccgaaggaaggggaagaagctgtgaagtattggtcattgctgttgctgggttgcatgccattgctggcgcacgcggtggaggtcggcgagcgtctggcgccctggaccttgctcgatcaattcgaccaggcctatagcctcgacgggcaggcacggacgctgctggtggcgcgcagcatggacggcgccaagctgctggtaaacgccgccttgcaggatcgtcccgcgggttatctggaggcccggcacacggtattcgtcgcggacatccaacgcatgccggcggtgatcgccaggatgttcgcagtgccggcgatgcgtgattatggctaccgggtcatgctcgaccgtgacgggcgggtggcgccgcgctacgccggggctgtggataaagtcctgtggctgcagctcgacgatggccggctggtggctcaacgggagtacggcacggccgccgaactgcgcgcagcgctggagcaagcgcaaccatgatcagtgccgcgctgctgtcgccgctcactctcggcgccggctggctgatctatgtgccagtgctggtctgggccgcctggcgcgcgccctgggtcgagctgttcagcgacagccggcgtcagcatctgctgttcggtacggtgttcgcgttgttcatgttgtggctggtgcgccgggatttcgataccggggtgtcctatcacttcatcggcatgacggccgtgaccctgttgctggactggccgctggcgatcgtcggcggcctgattgcccaggtagggctggtcgcgctgggccgccaggacctggcggcggtcggcatcaacggcgccttgctgatcctcctgccggtgctggtcaccgaatgctgcgcgatcctggtggagcgcgcgcagccgcgtaatccctttgtgtatatcttctgttccggtttttttgccgccgccctgtcggccttgttgtgcctgctggtgggtctggggctgctgtggttcgacgggcgttttgccatgccggaatggctggaggacttcgtcggctacctgtggctgatcatctttcccgaggccttcatcaacggcatggtggtcagcgccctggtggtgttctgccccgaatggctggaaaccttcaaccgcacccgttacctgtcggcgccgtggaaggatgacgatccgcgttcttgatccatatcaaacacgttcggcaggcacggtcccatgctcggcaaaaaccgttcgggagcagggtcatgagtgtgtatgaatgggcgcggcaggaagtacgcaagagtctggatactgcgcagcaagagggtttcgaaccgggcttgagcctgcgtgccctgctcagcgcggtggtgcaggagagtcggcgggtacgcagcggcgaggatctggccgacgagttgcagtttctcgcggagaacctcgacgatacgcagggctatggtttcatgcggccttgaggctttagtgggcgcgcggcggcagatcgtcggaaaacagatcgtcctcggcatccgggctgaccggaatcttgtgttcttcggcagcccaggcgccgaggtcgatcagtttgcagcggtccgagcagaacggacggttgacgttgctcgcggtccattccacgggcgcaccgcaggttggacattccacggtcaggggttggctcatgactggcctccacgcaaggtaaggtaaaagtgatgcaggcgttcgacctcgctgtgcagccaggcgaggtcgcggtcgttgaccagcacatcgtcggcatggctcaggcgatcttcgcgggtcgcctgggccttgagaatcgcctggatctgctgttcgctgatccggtcgcgttgcagggtccgctcgatctgcagttgctgcggcacatcgatcaccaggatccgctgggtcatcgcgtattgcccggattcgatcaacagcggtgacaccaaaatcgcgtagggcgactcggcgcgggccaggtgggcggcgatttcatcggcaatcaacggatgcagcaaggcttccagccagaggcgttgttgcggcacctcgaagatcagcttgcgcagcgcggcgcggtccagttgaccatcggcctgcagcaggctgtcgccgaaatgttcggcaatgcgggccagggccgggcggccgggttccaccacccagcgggcggcgtgatcggcatccaccacatggatgcccaggtcgatgaagtgctgggccgcggcacttttgccactgccgataccgccggtaaggccgaggatccagggtttgaaaacaggcttggtcatctgaaaccgacaaactgcaaataggagtcggttatttgaccaccccagagcaaggcaatccagccggcaatggccagaaagggaccgaaagggataggcgtggacatttgcgcgcggttgcggcgcagcatggcgactccggccagggctcccgtcagtgaggccagcagcagggtcatcggcagaatctgccagccgccccaggcgccgaacatggccaatagcttgaaatcgccgtgccccatgccttccttgccggtcagcagcttgaacaaccagtacaccgaccacaggcacaggtagccggccacggcgccccacagcgcatcgtggaggctgacgaacagctcgaagccattgacgatcaggcccagccacaacagcggcagcaccagcacgtcgggcaacagttgatgatcggcatcgatcaggctcatcgccaacaggccccagctcaggaacagcatcaggccggcctgccagccgaagccgaaatgccaggccacgaatgccgaggccaggccgcaggtcagctccaccagcgggtagcgccggccgatcggggcctggcatgcggagcagcgtccgcgcagcagcaggtagctcaacagcgggatgttttcccagatgcggatcgggtgcgcacagtgcgggcactgggagtgtgggagcaacaggttataggtcggcccgacaggctcgtcgggcagcccgaggatgtcacgggcctgggcgtgccagtcgcgctcgagcatctttggcagccgccagatcagcacattgagaaagctgccgacaatcaggcccaggaccagcaccgatgctacgaagaccagcggatagctggccaggacctcagtcaatgacatgttcagatcgctgtgccgagttggaagatgggtaagtacatggcgaccaccaggccgccgacgagggtgcccaaaactaccatgatcacgggttccatgagactgctcagggtgtcgaccagggtatcgacctcttcctcataatggatcgcgaccttttccagcatgccgtccagggccccggactcttcgccgatggcggtcatctggatggccatgccgggaaagatgccggatgcacgcatggaaaaatgcaactgcatgccggtcgccacgtcctgcctgatgcggttcaccgcttgcttgaacacctggttgccggtggccccggccaccgagcccagcgcctccaccagcggcactccggcggcgaaggtggtggacaaggtgcgggcgtagcgggccaccgcggacttgtacatcagtggcgctaccaacggcagtttcagcaggcccacgtccagccagtggcgaaagcgcggtgagcgccggcgggcatggcgcaggccgaacacactgagcaacagcgcgcccgccagcagccaccaccagtgctgcacgaattccgagagggcgatgaccagttgcgtgaacaccggcaattgcgcgccgaagccctggaacatcgactggaactgcggcaccaccttgaccagcaggatccccgtcaccaccagcgccacgcagatcaccgccaggggataggtcatggccttgcggatccgcgtcttgaggttttcgcttttttccttgtaggtcgccacccgctccagcagggtttccagggccccggcctgttcgccggcatccaccaggctgcagtacagctcgtcgaagtgccggggcctcttgcgcagcgcgctggtgaagctgctgccggcggcgatgtcctgtttcagctcgcccatcagtttgcgcatgttcgggttgtcgaagccctcggcaatgatgtcgaacgattgcagcagtggtacgccggccttgatcaaggtcgccagttgccgggtgaacaggctgatgtcgcgggccttgatcgggggcgtgcgctgcaacagcgagctgggtttcttcctgaccctggccgggttgatgccttgcttgcgcaactgggccctgatcagtgagggggtatggccgctcaattcgccgcgcagtttgctgccttgcctgtcggtgccttcccacaggtaaacactgacttttgctgctttgaccgccatggtgtcgagtcccgggttgtgatggatgtcctcagggccggcaatgccctgtgcgttagcgagtggaccgctgcgcggggcgcggcgtccggctcatagagtttgaatggcccgatacgttccttggatggggcgggcagtgaatgcgatcgatgatcgaatgacagcgtagcccgtcacggcgaccggcccagggcacttggctgacaaaaagtgtcagatagtgcgacttctggcgctcaccgccgcagctttgcgccgctaaagccccgttcggctggggcgcagacgctggcacaggctgtgctatggctgtgtggtgaatgcccagacccctggatatcccctgcttggagcagatagatgaagtatcagaaaggttttaccttgatcgagctgttggtcgtcgtggcgatcatcggcatcctggccacctttgccatgccgctgtattccaaataccaggcgcgggccaaggtcaccgcggcgttggccgaagcctcggcgctgaaggtcaatttcgaggacgtgttgaaccagggcagcgatccgaccctggagctggtggggggcaaggcggcgacgtcgaactgcaccatgaccgctgcgggttcggcctcgaccggagcgggaacaatcggctgcaccatcctcaatgcaccggcgccggtgctgaacaagaccgtcaccctgacccgcaccacggccgatggctgggtctgcaccaccactgtccccgcggactactcccctaaaggctgcaccgccagcggcagctgagtccggttctcgcttgcctggcgcgtgaaacgccacgcgccagcgtgcctttggggaaaatatcgagaattcaggaagttagctcgccgggaagtgcaacttgcatgcagattattcacaggtcatgcattttgcatgaccgcgagtgcttggatgattttgtaattctttgatatttaagggctttattgtttttctgaacttggcataacgcctgcaatctacttaagtaaccctgctgccaggacttggagcaggttttccagaagaacaggagttactcgtatgaagaagttcgctatcgctgctgcaactgctaccgctctgaccctgaccatggctaacgtcgcatttgcccagaccactcaagctactcaggcgccaatggtgctcgcggcgggtgaagtgaccaaggccaaggaagccacttccgacacctggatcaccaccaaagtcaaagcggatctcgtaactgaaaaaggcattcctggtaccgacatcaaggtcgaaaccaacaagggtgtggtttccctgtcctccactactgcgctgacctcggcgcagaaagaaaccgcagtcaacatcgccaaaaacatcaaaggcgtgaaggcagtatcggctgacggtttgaaaaccgactaagcctcaagcttctttcctggacagggagaagatgcggtagaggattcatctaccgcttccttgaaggttcatgcgaatggccacagggaagtggctccttttgtaaacagaacaggccccggcacagtgtgtcggggcctgttctgttcatggcggggaaaaccgccgggccgacccgtttccggggcggcggggaggggggttattcggcgtccaggtgcatgggggtaatgacccgaccatcgctttcggcctgaccaaggttggcatcgatgaagtagacccgatcgtccgtcagttggcccttgtccaccaggaagtccttgatgctgctggcccgttcctggcccaactggcgcaacagcacatcgctgccactccagaacttgatcacgccttcacgcattttcgcggtgcgctcttccttgcccaggtccttccattcggccggtggctgggtcttgaggcgtgtgcgatagatgccctccagcagcggggctttctctttctccggtacttccagcagcgacgcctgggccggcaccttgtcgccgcgacgctggagcatcttgtagtagttgtactggtattcccgctccaggcgttgctcggcgatcagcgggccatcgctgctctgcgcggcggtgccttcgatctccaggcgcagggccggacgttccttgagtgcattggacagcttgaccagtgccgcttccgattccgggctcaagtcactcgagcccggggcgaacgagacactgcccaagtcctccgaaccgccacccgcgaccagcccgccaatcagtttgaacggtgccgcggcagccttgacgatcaggttgcgcagggtctgccagacaatcggcatgacgctgaactgcggattgttcagatcgccggtcaccggcagttcgatggagattttgccgtcgacatccttgagcaaggcgaccgccagtttcagtggcaggctcacggcatccgggctgtcgactttttcccccagctccagttgttcgaccaccactttgttttcggccttgagttggccgttggtgatgacgtagtgcaggtcgaggttgagccggcccttgcggatgcggtagccggcgaacttgccggagtagggggtcaggttggtcagttcgacgcgtttgaagctggtggcgatgtccagtgcggccatcggatcgaaggggttcacgctgcccttgatggtgaccggcgcataacgatcgaccttgcctttgatatcgacgttggccggttttgcctggcggctgtcgatggtgccgatctggccattgagttgctggacggccgtggcgaagttgggggtcaggctgaagtcggcgaagttggccgaaccgtcgttgatggcgatctggccgatatggatgcccaggggtttttccttggcggtcggcttggctgcgcctttcggcgcgctgtcggccggttgcgggatcagcaggtcatcgatgttggtggtgcggtcatcgttgatcatgaagcgcgcataaggctgcatcaggttgaccttgttgatcgtcaggctgtcgccgtgctgatagttcaggccttcgagcaccagttgctgccatttcacgaagtcgcgggttttcagggtatccagggtgtgcaactggtcgacctgggcgcggccagtcacgctgaatgtcaggggatcgatgtttttcaggtccaccgccaggtcgctaccgagcatgccgctgcgcagctccaggcgaatgaacgggctgatgtaggactgggcgacccgcaggtcgatgtccttggtctgcaccgccagcttggcggtcaccggttgcaggttgaccacgccgttggcgaggatcttgccctgtttgcccactccggtgtcgagcttgaggttgaaaggcgactggttgaggctgtcgaagttctgcacgtcgacgttcagcgggccgacctccagggccacggccggcttggcctgacggtccgccaggtgcacctggtaattgcgcagttgcacgtccttgagcagcacctgccagggtttgctcggcgccggagcgggagccggcggagtatcggcggcggccggagcgggcttggcggccggtttggccggctggctggcgaacagtttctgccagtccagttggccatcggcctccagggcggcccaggtttccagtttctgactgcggatcttgccgaccaccacttgctgcttggccaggtcgaccgtggtttcactgacgtccaggcgctccaggcgggccagtggccgaccgtcgggggccttgatggcgaagggcgcgacgctgaccgaggcatcgctgagcagcagctcggtttccttggccaggttcagcttgtagcgggtgttgaggttcagcacgccgtcttccaggaccaggggcagcgcgtcgcggacatagggccaccagactttcatcttgccgtcggtgactttcagggtgccttcggacgcgatggggaccaggctgaagttgccgctccagtcgatctggccaccctcgggcccggcggcgaccagggtcatgtcggcattgtcgtcgggcagggtgctgaggttcttcagttcgaaatcgagcttgtcgtacaggaactcgatgggctcgctgggccgtgcgtcctggaagtgcacataaccaccggccagcttgatgcgctcgatacgcagggggaacggcttggcctcggggtcgtccggagtgggttcgctggcgggcaggttgaacaggcccagcaggttgagcttgccgtccttggcgaacaggatctcgctcttgggtttgtccagttcgatatcggccaggtgcagcgcgcgggtccagaggctgtccagttgcaggttggcgtagagacgctcgaaggccacttgctccttgcccggctcaccgatattcaggccccagagtgtcagttcgagactgaacgggttgagttcgatgcgctggatctttgccggtaccgtcgcgtagttggccaactgttgattggccacccgcaaggcgatgcccggcaaaatcagaaagcccaacagactgtacagggcgagagcggtcaacaaggcgccgatagcgcggatcaatcctttggacatgcgaggcttcatctatctgaatcggaagtgcgttggagtatggcatgcgtttccggttccgaaacaatcccatgacggtcgcaaacaggattgttcagattcctcgcagcagatcacagatgcaggatcagggtcttgagcggcggttgctggtccatggacgggaagtcccgagcgggtgtcagcacctgccattcgcgtaccgggcgaccggctttttcggcacagcgcagtacctgttcgcgccagtcgtccagcgtgactttcgccaggttgttgcagcagatcagcacgccattgtcggcggtggccagcagggcaggcttgagcagactctgatagtcgcgcagcaggtcgacggtgccgaatgcgctcttggcccaggccggcgggtcgagcagtaccaggtcgtactggcgttgttccaggcgtgggtagctgggcagcttttgtccacggcgctggctgatgggcaggccggccagttgccggatcgccgggaagtaatccgattgcacgaactgcatggccggcaattgcggattgagctggccgttctcgcggccgaccgccaggttgccctcggcgaagtccaggttgcacacctcgcgggcaccgcctgccgcggcactcaggccgacaccgcaggtataggcgaacaggttcagcacgctcttgccggcgctgtgggccttgacccagccacgggcgttgcgcaggtcgagaaacagcagcgggtcctggccggcatggcgaccgcgtacccggtagttcaagccccattcgtggccgaccaggtctttgagcgcctcttctgcggcgcggtaaaccgagtcctcgcggtcgatgcgtgagttgccccgggagcggtcgttgtagaccagcagggtgtccaggcccagttgctgctggacggtctcgtgcaattgcagcaaggcatcgcgttccagcgtctggtgaaagctttgcaccagcagctgcgggccgtaacggtcgatggtcaggcccccggcgccttcctggctgccatggaacagccgatagcagtcggtgccttgctgatgcagctcgacgagcaggtcctggcgatgatcgagggcggcgcgcagcgcctgattcaaggaagacatgcgggcgccttgcggatgattgggcggggcagtctaccagtttcgttttgtcctctgtgtaggagcgagcttgctcgcgaaagatcggccgcaacatcgcgatgcaccaggcagaccgcgttaccgttgaggtccatcgcgagcaatcgagcgtcgaccggccgctcctacaaggggattgtggtcagcgttcgatggccaatgccacgccctggccgccaccgatgcacagggtggccaggccttttttcgcatcgcgcttgagcatttcgtgcagcagggtcaccagcacccggcagcccgaggcgccgatcgggtagccgagggcgatggcgccgccattgacgttgaccttgctcgcgtcccaacccagttccttgcccaccgacagcgcctgggcggcgaaggcttcgttggcttcgatcaggtccagctgctccagggaccagccggccttgtccaggcagcggcgggtggccgacaccgggccgatgcccatgatcgccgggtcgaccccagcgttggcgtaggcggcgatcttcgccagcaccggcaggcccagggcccgggccttggcggcgctcatcaggatcaccgcggcggcgccgtcgttcagcgacgaggcgttgccggcggtgaccgtgccgtctttcttgaaggctggcttgagcttgcccagggattcggcggtggtgccggcgcgcggctgctcgtcggtggcgaaggccacgggctcgcccttgcgctggggaatcaggatcggggtgatctcatcgacgaaacgtccgccctcgatggcggccacggccttctgttgcgaggcggcggcgaaggcatcctgggcttcgcggctgatggcgtatttgtccaccaggttctcggcggtgatgcccatgtggtagtcgttgaaggcatcccacaggccgtcgctgatcatgctgtcgacgatctggctgtggcccatgcgcaggccggtgcgggcaccgggcagcacatagttggccaggctcatgttctcctggccgccggcgatgatcacctcggcgtcgccgcagcggatcgcctgggcgcccaggtgcagggccttgaggccggagccgcagaccttgttcagggtcagcgccggcaccgcgtggggcaggccggccttgatcgcggcttggcgcgccgggttctgcccggcgccggcggtgagcacctggcccatgatcacttcatcgacctgggcaccgtccaggccggtctgggccagcagctggcggatcaccgcagcgccgagatcgaccgcagggatggttcgccagcgaaccctggaaactgccaaccgcggtgcgggtggcggcaacgattacgacgtcttgcatggcgcgaatcctcattgtcattggcggcatcggtcggcggtcattggcaggtgaccggtgcgcgagaacttggaaaatcatggttgcatagaaggtcgcgacgctgccaatcgcgaaccggtgggtcgcgttctgttcgcccggtcgggtattacaggcccatgcgccggcgtgcgcgatgtatcgagccgttgcgtaccgcccagcgcagcatcggcgcactgcggttgacgctggcgcggatcagctggcgttgcagcagaccctggttgacgccgagcatgtcgctggcccagtcgggcaacaggtcgatgccggcctgcatcatcaacgagccaaatggcttggccaggcggcttggggcaggtgccgccaagagcaaacgcagcacttcacggctgcgttcatcgcagagcagctgggggcgcgtccgtgccaggtagtccgccacggcccggcgcgagcgcggtacatcactggcgccaagacgctcggcgatcagcgcgacttccccgtagtaacggtcctgctcggcaggcgacagctgcgggttgcgataacgcaggtgcgccgccagaaaactgctgacctcggccacatgtacccaggtcagcagttgcggatcgctggcggcgtatggccgaccgtctggtgcatggccgacgatctgcaggtgaatggtgcgcaccttgtcgatcagccattcggcatcctggcgcgagccgaaggtggtgccggaaatgaactgcgcggtgcgccgcaggcgcccgatcatgtcttcccggaagttcgagtgatcccagaccccggccagggccagcgggtgcagggcctgcatcagcaaggcgctgatgccgccgatcagcatgctgctgaaatcgccatgcacctgccagcagatggcgtccgggccgaacaggcccgggtcgcccttggggttgtccaggtcgagctggcccagcgacaggccacccaggctcatgacctgggtttcgatacgactgcgaatgaattccatgccgcttggctgttccttggtttaagcccgaggccctgctcagaggttcaggcgtttatcgatcaggccctcgaccacgctcgggtcggccagggtcgaggtatcgcccaggctgtcgagctcgttgcaggcgatcttgcgcaggatacgccgcatgatcttgcccgatcgggttttcggcaaggccggcgcccactggatcagttccggcttggcgaaactgccgatctcgcgactgaccaggctcaacaattccttcttcagctcatcgctgggctcgacgccattcatcggggtgacaaaggcatagatgccctggcccttgacgtcatggggatagccgaccaccgcggcctcggcgatgctgtcgtgcaggaccagggcgctttcgacttcggcggtgccgatgcgatgcccggacacattgatcacgtcgtcgatgcgtccggtgatccagtaatcaccgtcttcatcgcgccgcgcgccgtcgccggtgaagtagtagcccgggtagggtttgaaataggtctcgaccatgcgctgcgggtcgccgtagacgctgcggatctgcgccggccagctggccttgatcgccaggatgccgctgccggcgccgctgatttccttgccgtgctcatccagcagcaccggttgcacgccgaacatcgggcgggtggcgcagcccggcttgatgtagctggcgctgaccagcgggctgagcatgatgccgccggtttcggtctgccaccaggtatcgacgatcgggcagcgctgctcgccgacgctattgaaataccattcccaggcttccgggttgatcggctcgccgacagtgcccagcaggcgcaggctgctgcgcgaggtgtgctgcagcggctcggggccttcgcgcatcagtgcccgcaatgcggtgggggcggtgtagaagatgttcacccggtgcttgtcgatgacctcccagaagcgcgagctgctcggataactgggcacgccctcgaagatcagggtggtcgcgccattggccagcgggccgtagacgatgtagctgtggccggtgacccagccgacgtcggcggtgcaccagaagacttcgccttcgcggtagtccagtacgtatttgaaggtcatcgccgcttgcagcaaatagccgccggtggtgtgcagcacgcctttgggtttaccggtgctgccggaggtgtagaggatgaacagcgggtcctctgcgtccatcggttgcggcgggcagtcgtcttcgacgccgcgcagggcctggtgataccagaggtcgcggccttcgacccagttcaccgggttctgggtgcgctcgaccaccaccacggtgctgacgttcgggcagctttgcagggccttgtcgacgttgtttttcaagggtatgaacttgccgccgcgcaccccttcgtcagcggtgatcacggtgcggcagtcggcgtcgagaatgcggtcgcgcaacgcgtcgggggaaaatccgccaaagaccaccgagtgcaccgcaccgatacgggtgcaggcgagcatggcgtaggccgcctcggggatcatcggcatgtagatacatacccggtcgccttttttcacgccgcggcttttcaggacgttggccaggcggcagacgtagtgatggagtttcttgtaggtgatttgcagcgattcggcagggtcgtcgccttcccagatgatcgctacctgatcgccgcgtttttccagatggcggtcgatgcagttgtagctgacgttcaactggccgccggcgaaccagctggcggcgccggttttcaggtcatagcgctgcacggtttgccagggagcgctccagtcgagaaagcgggtggcctgttcggcccagaaggtactggggtgctcgatggattcgcggtacagccgctggtagtcgtcctgactcaattgtgcggcccggcggacggcatcggcttgggggaacatgctgatatcgaacatgacggttccttattcttgttttagcgacaagtaataaagatgcgccttgatcggaaggggttcaaggggagggcggtcttgggcgaccgatcgcgaaccggcccgctgctatgcaatggtttgcacagcagtgggccggttcgcgaagggggatttcagcgggctatcaaccgcggtggcgaccgcggaagtagttgatcaggccctgggtcgaagcatcctcggccggggtttcttcgctgccgaccaggcggttgtagacgcccttgcccagctccttgcccagctccacgccccattggtcgaaggcgttgatgccccagatcacgctctgcacgaacaccttgtgttcgtacatcgccaccagcgcgcccaggcggcgcgggctgatgcgttcgaccaccagggtgttgctcgggcggttgccggggatcaccttgtgcggtgccagcttctggacttcggcctcgctcaggcctttttcacgcagctcggcctcggcctcggcgcgcgtcttgccgagcatcaacgcctggctttgcgacaggcagttggcgtacagccactggtgatggtcggccaccgggttgaagctgacgattggcacgatgaagtcggccgggatcaactgggtgccctggtgcaacagctggtggtacgcgtgctggccgttgcagcccacgccaccccagatcaccgggccggtgtcggtggaaaccggcgtgccatcctggcggacgctcttgccgttggattccatgtccagctgctgcaagtgcttggtgatattgcgcaggtagtggtcgtacggcaggatcgcgtggctttgcgcgccccagaaattgccgtaccacacgcccagcagggccaggagaaccggcatgttctgctcgaacggcgcggtctggaagtgctggtccatggtgtaggcaccggacagcagttccttgaagttggacatgccaatggccagggcgatcggcaggccgatggccgaccacagcgagtaacgcccgccgacccagtcccacatcgggaagatgttctcttcgcggatgccgaaggccaccgcggcggcgttgttgctcgacactgcgatgaagtggcgatacagctcggcctcggagccgccctgagccaggtaccaggcgcgtgcggcctgggcgttcttcagggtttccagggtattgaaggatttcgacgagacaatgaacagcgtggtttcggcgcggatcttcgaggacagctcgtggaactcgctgccgtcgatattggccaggtaatggcaacgcacgcctttctgggcgtaggacaacagggcttcggacaccagctccgggccgaggaaggaaccgccgatgccgatgttcaccacgtcggtgatcggcttttcggtgtagccacgccacaggccgtcatggatgcgcccgaccagctcggtgatctggttcagcaccttgtgcacttccggcatcacgttgacgccgttgaccgacagcttgtcgcccaccgggcggcgcagggcggtatgcagggccggacggccttcggaagagttgaccagctcaccggcgaacaacgccttgatcgcgtcctgcaggccggcttcgttggccaggcccaccagcaggttgcgggtttcggaggtgatcaggttcttcgagtaatcgagaaaaagcccacagccgctgaggctgaattgatgaaagcgctgcgggtcggcattgaaggcctcgcgcatgctgaaatcctgcatggcctggcggtggtcattcaacgcttgccaggcgggcagagcggtaacgtcgtgaggagtgcggtagtacgccatcgctgcggttttccttttacttgaactgcctgttggacactgaaaagcccggaacgtcctgctcgaagaataacgttcggtcaaacctgcgctgacacgattaagcacgcagggcgataacagtaactctcgcgtgctgatctgtcttggctttgtctgacctgcggccggtacttttttatactggcgcctcagagccgcgcacgaacgggatttcagggctgagaatgactggggttcaggcgacctgaaccgggatggcatggctggtgtggctcagctcgttgcccggcgccatatagagcatgcgtggcttgaagttgagcagttcggcttcgctgtagtgagcgtaagcgcagatgatcacccgatcgccgaccttggccttgtgcgcggcggcgccgttgaccgagatcatgcgcgagccttcctcgccacgaatggcgtaggtggtgaagcgttcgccattgtcgacgttgtagatctggatctgttcgtactcacggataccggacaagtccagccattcgccgtcgatggcgcaggagccttcgtagtcgagcacagcgtgggtgacttcggcgcgatgcagcttggccttgagcatgatggcgtgcatgagtggttctctcggtcggatcctcgaacagggcccgcagcatcgctgcaggccccgggcggcggcagtttgcccgaaggtcgggcttcgggcaatcggcctttgggacctaggcgtcgaggtccagatgcaggttgtcgatcaggcgggtagcacccagataggccgccgccaggattaccaggtcgcggtcttgcgcggtggccgggcgcagggtccgggcgtggcggatttccaggtaatcggggcgaaaacctgcggcttcgagcactcgtttttgctcgtccagcagctttgggtagtcccgctcgccctggctgatggcctcggcgatctgagtcaggccacgatagatcgcgggggcgatggcacgttgttcctcgctcaggtagccgttgcgcgaggacagcgcgaggccgtcggcggcccgcacggtgggctcgccaatgatctggatcggcatgttcaggtcatgcaccagggcgtggatcaccgccagttgctggaagtccttctggccgaagaccgcaaggtccggctgcaccatgttgaacagcttgctgaccaccgtggccactccttcgaaatgcccgggacggctggcgccgcacaggccttcggagagctggggcacgctgacccgggtctggccgtccatgccgtcggggtacatctcttcgacggtcggggcgaacagcagatggcaaccggcttgcaggagcttttcctggtcggcggccagggtccgcggatacttgtcgaggtcttcgccggcgccgaactgcagtgggttgacgaaaatgctcgccactacgaaatccacccgctgggccgccttggtcaccagggccgcatgaccgctgtgcaggttgcccatggtcggtacgaagccgatgcgcttgccctcgctgcgggcacgggccacagcggcacgcagttcacgtacggttttgacagtattcatgcagaaaacccgtgttcggcgcctgggaaggtcacggccttgacttcattgacgtaggcgctcagggccgcctggatgctttcctggccggccatgaagttcttcacgaacttcggcgcgcgaccgctcagggacaggcccagcatgtcgtgcaggaccagcacctgaccgtcggtgccgctgccggcaccgatgccgatcaccggaatcttcaccgcctgggtaatttccgccgccagttcgctcggcacgcattcgagcagcagcatcgctgcgccggccgcttccagggcgatggcgtcggcacgcatctgccgggcctggttttcgttacgcccctggaccttgtagccgccgaggatgttcaccgattgcggggtcaggcccatgtgggcgcagaccgggataccgcgttcggccagcaggcggatggactccgccagccagagcgcgccttcgaccttgatcatgtgcgcaccggcctgcatcaactgggcgctgttgttcagggcctgttcggtggtggcgtaggccatgaacggcagatcggcgaggatcagcgcgccactgttaccgcgtttgaccgcggcgacgtggtaggccatctcggcggtagtgactggcagtgtgctgtcgtgcccctgcaagaccatgccgagggagtcgcccaccagcagtacttcaacgccagcctggcaacaggtgtgggcgaaggttgcgtcatagcaggtcagcatggtgattttttcacctttctgcttgaggccttgcagggtggtcagggtgatgtctggcatgaaaaagggtcctcattcaggcgctctgggaactgctgcgagtaacgcgcgtgattctttatctatgcaggcgcacggtctgttgtcgtgcttataaggcctggcccaagctatgtgaaagctactgcgctcggtaatcctgcgttaaaaacaggctcgggctgctcatttacagcacgtaaactccgcgccctcgcctgtttttgcctggtcttaccttcgctcgctacgctttcacacagcttggaatgcgccctgtaacgccgtgttggcggcaacgggacgcctatagtcgtgaggagaactcgggaagtcaattgcatgtgttaccgcattgttacggcgtgagtgttaccgccgtaactgatgcgtttcagcagtcaggccagacgttccaggccgacaaatgggcaggcggcgagcagatcgcgcaggtggcggccgtcggccagttgcaggtcggcgggggccagttcggccaggggatatagaacgaaggcccgggcctgcatatggtaatgcgggaccttgagtcgcggttcgtcgatcaggcgatcgccgaacagcaggatgtccaggtccagggtgcgcggtccccaacgctcgagacgctcgcggccctggccgttttcgatggcttgcagcgcgtccagcagttcgaggggcgcgaggctgctgtctagggcggccacggcgttggtgtaacgcggttggccgggcagcagggagtcactttgatagaaggccgagacccccgccagttggctgtgcggcaactgcgccagggcgtcgatcgcgctgcgcaattgctccgccggggcagccaggttgctgcccatgccgatgtagatgcgttccatcgggttattcgccggaagcgctcggtgcgccggcggtggcacgtttgcgtttggcgccactgctgcgacgacgcttgcgcggacctgtgccggcttcgtccttgccgctcagatcgcgaatcatgtcgcggcgaccggcttcgttggcgtcctgatagtcggtccaccattcgcccaggccatcggtctgttcgccggcgctttcgcgcagcagcaggaagtcatagccggcgcggaaccgcgggttgtccagcaactggtcggcgcgcttgccgctgcggcgtggcagacgttcctgcatgtcccagatttcgcggatcggcatggtgaagcgttttggaatggcgatgcgctggcactgttcgctgatcaattcgtgagcggcttcctgcatcgccggaattggcggcatgccgcgttcctggaggcgcagcacgcgagccggcaaggcaggccatagcagcgcggcgaacaggaaagctggggtgaccggcttgttctgcttgatgcgcaggtcggtattgaccagggcttcgctgatcagcgtatgggtgtaggtcgggttgtactccagcgcctcggcgctggccgggaacagcgggtcgaacagttgcaggtcgaccagcatctcgaaggtgtcggcggcatggccggacaggaacagcttgagtacttcctcgaacaggcgcgccgaggggatttcccgcagcatgggggccaggtcgcggatcggcgtggcagtgtgtttctcgatgccgaaatccagcttggcggcgaagcgcacggcccgcagcatgcgtaccgggtcttcctggtagcgctggcgtgggtcgccgatcaggcggaccaggtgattgcgaatgtcgtgcacgccgttggcgtaatcgaggatgcgttcgctgaccggatcgtaatacagggcattgatagtgaagtcgcggcgctgggcgtcctcttcgagggtgccatacacgttgtcgcgcaggatgcgcccgctttcgttgcgcgaggattggttgctgtcttcctcttcatcgttttgcgggtgattggcgcggaaggtcgcgacctcgatgatttcgcggccgaagtggatatgcaccaacttgaaccgacggccgatgatccgcgcgttgcggaattcggcccgcacctgttccggtgtggcgctggtggcgacgtcgaaatccttgggggtgatattgagcaacatgtcgcgcacgcaaccgccgaccaggtaggcctgatagccggcgttctgcaggcgttcgacgatgttcaccgcataacggctgaactgggcgcgttgcagcgaatgttggctgctgttgagcacttcaggcgtgctgcgtttgtgttgcgtacgacgcaagggagaacggaatgactggaacaacttcttcagcatgggatgcactgtttgaaggaatgttcggccataacgaagaatgaccgcatgatgggcggggattctagcatttagtcgggggatggtgtaggaagctgcggcgagtcgtgcgcggggctttggaacgcgggttggcggggctttgcatcagtaaagtcgcaatcgcggaaaccacaaggggagccgaagctcccccagaagtgtttgcgtgctctatttttattattggtttcgggcttcttgtttttgtttaacgcccttgtcacctggttaacccaggatgaccctcccaatcgggagccaagagcaaacggattgctttggtcgctgtgttgcaatgatcgatgatccaaccagttcaggctctgccttagggcagtttttgttgttctcggcctggttgtggggcaagccccaatgacaacgcctctccaaaagaatcagttagctgcgcctccgccatgttgtttttattgtgcgtgagtcgattcgtcttatttttattgtcttatgcattgcttgttattgttcttgtaccaaacatatagcaggtgccgtgccaacttttgtgaggtccagtaaaacaaggggttaggcgtggttttgaggttttcgcgggcgaaaaaaaaccggggcttcgttaccttaagccccggcttttgttacgtgaaatgactgaggtaacagttttttcacaaggtcacgtgttacccgcaacccgttaccgccgaacttcagctttcgctggcgaccccggtcttgcgccgtgggatgcccaggcgctggcggcgttcccacaggcatttgcggctgacgcccagtttgcgcgccagttcggtttcggtcatatggtcctggtgctcgaggacgaaatgctggaagtagtcttccagcgacaggtcttcggtcggctcgtggctgctgttgttggcgttggcggcctgggacgccaggccgatgaattcgtcgtcttccagatcgctcagttcgatatcgatacccagcagctcggcggagatttccgggctttcgcacaggatgaccgagcgctcgacggcgttttccagttcgcgaacgttacctggccacgagtagtgacgaatggcttgctcggcgtccggagcgaacttcaggtcagtgcggcccacgcgcgcgctttgacgggcgaggaaggcattggcgatttcgttgacgtcggcgccgcgttcgcgcagggctggcagtttcagggcaatcacgtgcaggcggtaatacaggtcttcacggaactggccgatcttggccaggctcttgaggtcgcggtgggtcgcggcgatcaggcgcacatcgaccttctgcgactgcaccgagccgacccggcgaatctcgccttcctgcagcacacgcaacaggcgggcctgggcttcgagcggcaattcgccgatttcgtcgaggaacagggtgccgccatccgccgcttccaccaggccggcgcgcccggcgctggcaccggtgaaggcgcctttttcatgaccgaacagctcggactcgatcagggtttccggaatggccgcgcagttcaccgagatcatcggcgccttggcacgcttggacaggttgtgcagggcgcgggctaccagttccttgccggtcccggattcaccctggatcagtacattggagtctgtcggggcgaccttgcggatcttgctgtacaggtcctgcatcggtgggcaggaaccgatgatgccgatttcgccgttgctggcactggcgccagccttgtccgcaccgttgcccggcttggcggccggccgctcgttcgtattgctttgcgcggtctggcggtcgcgcaggatgcgcgccacggcctggagcatttcgtcgtggtcgaaaggcttggcgatgtagtccaccgcgcccatcttcatcgagtcgaccgccgagcgcaggctggcgtagctggtcatgatcagcaccggggtgccctggccgagcttgatcagttcggtgccgggggcgcctggcaggcgcaggtcgctgacgatcaggtcgaacgtgggaatgctgaaacgctcttgtgcttcctgcacggaaccggcttcgctgacctggtactggttgcgttccagcaggcggcgcaaggcggagcggataattgtttcgtcttcgacgatcaaaatgtgcggcattgattcgattctctcgacggtctcagttcacagcggacgtcgcttcgacatgacgcggtaaagtcacccggatacgggtgccgcgttggctttcggtgtcagccgggctgtcgatggtgatttgtccataatgctcttcaacgatggaatagaccagtgcaaggcccagtccggtgccctcgccaggatccttggtggtgaagaagggttcgaacagtcgatccatgatgctcgacgggatgccgctgccttcgtcttcgacgatcagatcgatcgtgtgttcgccggcctcgctcttgacccgtaccgcgctgcctgccggtgaggcgtcgcgggcattggatagcaggttgatcagtacctgggcgagccgctgcgggtcgccgtcgacccagtggtccggatcgcacaggttgaagaattgcacttcgaagttgcgccggttcagcgccagcagaccaatggcgtcctgcgccacttcggccaggcacacggcttcgtcgttgtgctggtggctgccggcgtgggcgaagctcatcagcgactggacgatgcgcgacacgcgcttggtctgttcgagaatctggccgctgatttcagtgagttcgccgtcttcttcgcgctcttcgcgcaggttctgcgccaggcaggcgataccggtgatcgggttgccgatttcgtgggccacgccggcggccaggcggccgatgctggccagccgttcggagtgcaccagcttgtcttcgagcatctgggtttcggtcaggtcttccaccagcagcaccaggccgctgttgcccggggccaggggttcgtcgatggcggccttgtgcaggttcagccagcgggtctggccgtcgagggccaggtgctgtttatgcagatgttcatcggggatgttgatgaagccttgcagcagctctctccagggatcggcgatggtgctcaggcgcgaaccgaccacatgctgcgccggaatgctggtcagttcctccatggccttgttccacatgaggatttcctggtccttggccagggagcagacacccatcggcagttcctgcaaggtctggcggtggtagcggcgcaaggcatcgagctcggcggccaggccggtcaggcgcgagtggtagtcctcgagccggctttcgatgaagtgaatgtcttcggtcacatagttttcgccgccggccttgtagggcaggaaggtttccaccatgtcctgggccacgctggggcccatcaggccggataggttggcctcgatacggtcgcgcaagcggcgcagggcataggggcggcgctcgtcgaagggcaggtagaggtcacgcagcgcctgctcgacttccttctgcgcggccttggcgcccaggggtttggccagctgggtggcgaactcctggggcgaggcagcatgcagttcacgacgttgcggccggcgcacgttgtccaccgcgcaggcttcggcggcgctggcttcttcggagctggcgttggtgaacagcgaaatcagggtgaacatcaggacgttggcggccagcgaggcgatagccgccatgtgccaactggtgtcgtccagcacgtagatcatgttcagcagcggtatatagaagccctgcaagttgccgatcagcggcagcaacatggtcaccagccacaccagcgtcccggccatcagcccggcgatgaagccgcgccggttggcagtcggccagtacagcaccgagagtacgccagggaggaactgcagggtcgcgacaaaggccacgatgccgaggttggccaggtcctgttcggcccccagcaacaggtagaaggcatagccggccatgatgatggccacgatcagcgcgcggcgggtccatttcagccagcggtagatgttgccttcggccggtggctgatacagcggcagcaccagatggttgagggccatccccgacagcgccagggtggtgacgatgatcaggccgctggcggcggaaagcccaccgatataggccatcaaggccaatgccggtttgttggcggcgatgccgatgccgagggtgaagtattcggggttggtggtggcgcccagtttcaagccggcccagaggatcagcggcaccgccaggctcatcagcaacaggaacagcggcaggccccagctggcgctgaccagcgagcgcgggttgaggttttcggtgaaggtcatgtggtacatgtgcggcatcacgatcgccgaggcgaagaacaccagcagcagggtgcgccacggcccttcctgcaatggcgtgtgcagggcggcgagggcggtctggttctgcagcagccagagttccagctgttgcgggccatcgaacacaccgtacagggcatagagaccgacgccgccgatggcgatcagcttgatcactgactcgaaggcgatggcgaacaccaggccttcgtgtttttcccgggtggcgatgtgccgggagccgaagaagatggtgaacagggtgatcagcgcgcagaaactcagggccacccggtgctgcaccggctcgcgggtgaggataccgatggagtccgcgactgcctggatttgcagggccagcagtggcaataccccgaccagcatgatcaccgtggtcagcgcgccggcccaggtgctgcgaaaacggaaggcgaacaggtcggccagcgacgacagttggtaggtgcgggtgattttcaggatcgggtaaagcagcaccggcgccagcaggaaggcgccggaaaccccgagataactggaaaggaaaccgtagccgtactgataggcaaggccgaccgtgccataaaaggcccaggcgctggcgtagaccccgagggacagggtgtaggtcagcgggtggcggatgatcgagcgcgggatcatgccgcgttcgctgatccaggccaccccgaacagcaccagcaggtacgcggcgctgatcaggatcatctgggtcaggctaaagctcatcggcatctttttggctctgcaggatgaaggtcacgacgatcaggatcagccagagcagatacgggcgataccaggcgcccgtagcatcgatccaccaatccatgatggcgggggagaacagatagatccccactaccagcagcaggaccaagcgatagatgtacatctcggcctctctttattgtgtgcgtgcccgaaaacgtgcggcgatggtaacggatgggcgccaacctgcaaggggcgtcagcggatttgcgcttcgggcacgctcagtgtgcgtgggatcagtaaagcatcccagtgttcgatgccccaactcagcacttcccgagagctggcatgggccatttcgctgtcggttttctgccccagggcgcgcagggcacgcaacagcagcggggtggcctggtccgcggccagcggcggggagcggtaggacttgcccagtttatgcccatccggctgggtgatcagcggcacatgcaggtagcgcggctgcggcaggccgagcagctcctgcaggtacagctggcgcggggtggagtccagcagatcggcgccgcggacgatatcggtcaccccttgccaggcgtcgtcgagcaccaccgccagttgataggcgtagaggccgtcgcggcggcggatcacgaagtcgcccacatcccgtcccaggtgctggcggaattcgccctggacccgatcggtgaaacgatattccagctccggtacgcgcaagcggatggcggcatcttcctggccatgtccggcattacggcacaggcccggataaatgccgtggtagggttccagctgcttgcgcgagcaggtgcaggcgtaagccaggccctggttgaacagacggttgaggacttcggcgtaggccgcgtgccgctcgctctggcggaccatttcgccgtcccactcgaagccgtagctttccagggccttgagaatggccgcctgggcgccgggctcttcccggggtggatcgaggtcttccatgcgcaacaaccagcggccgccgacggcgcgggcatcgagataggaggccagggcggcgaccagcgagccgaaatgcaggtgcccgctgggggttggggcaaagcgcccgatgtaggaagaggcgtgagagacagtcatggagaggatgttacttcgttcggtcccaaggtgacgatggcgtctggcggatcgctatcgcgagcaagctcgttcctacagggggtgagacggcagaaacaaaaacggagcgttcgcacgctccgtttttcatgcaagccagcgattatttgccgacttgtttttccttgatttccgccagggtcttgcagtcgacacacatgtcggcggtagggcgggcttccaggcggcgaataccgatctcgacgccgcaggattcgcaccagccgtactcttcgtcttcgatcagctgcagcgtcttgtcgatcttcttgatcagcttgcgctcacggtcgcgggcgcgcagttccaggctgaattcttcctcctggctggcacggtcggccggatcggggaagttggctgcttcgtctttcatgtgatcaacagtgcgatcgacttcctgcatcaagtcctgtttccacttgttcaggatcttggtgaagtgctcgcgcatgggcttgcccatgtactcttcgcctgcggtttcaacataaggctcgaagccgctgatcgattgattctgttgctttgcttgggtggacatgaaatggaccgcctctactcatgtaatccattgcgcaggattgctccatcaccgacacatgccggccctgcgactgcaagcgggcgaacttaccagatcaaatcggacggcgctactcccggttgtcgagcccgcgtcccgcggcgcttgcaaaggtcgatgccgcctggcctggtctgttcgggggcctggtcaattaatgattttagccaaacctgggcctgttgtcggtcttctttaattgggttggatggcggggcccaaaggctttgggctctcccttgtccccggggttgggtagaatcgtttttttgctcacttcaatgaaggaaggctaatggctcagccctacagtgcgcgcagccgcgctatcgaacctttccacgtgatggccctgctggcccgtgccaatgagctgcaagcggccgggcacgatgtgattcacctggaaatcggtgaaccggacttcaccacggctgagccgatcatcaaggccgggcaggccgcgctggaggcaggcaggacccgctacaccgccgcccgcgggattcccgagctgcgcacggccatctccggattctatcggcagcgttacgggctggacatcgaccccgagcgcatcatgatcacgcccggtggttccggcgcgctgttgctgaccagcagcttgctggtcgaccccggcaagcactggttgctggcggacccaggctacccctgcaaccggcacttcctgcgcctggtggaaggcgcggcgcaactggtgccggtcggtccggacgtgcgttatcagctgacaccggatctggtggagcgttattgggatcaggacagcgtcggcgccctggtggcatcgccggccaaccccaccggaaccttgctcacccgtgacgagctggcgggcctgtcggccgcggtgaaggcgcgtaacggtcatctggtggtggacgagatctaccacggcctgacctacggctgcgatgccgccagcgtgctggaagtcgatgacagcgcctttgtccttaatagcttttccaaatatttcggcatgaccggctggcgcctgggctggctggtggcgccgcaggcggcggtcggcgagttggagaagctggcgcagaacctctacatcagtgccccgagcatggcccagtacgctgcgctggcctgcttcgagccagacaccatcagtattctcgaagagcgtcgcaacgagtttcagcggcgccgcgacttcctcctgccagccctgcgcgagttgggttttggcattgcggtagagccggaaggggcgttctacctgtatgccgatatcagcgccttcggcggcgatgcctttgctttctgccggcatttcctcgagaccgagcatattgcctttaccccggggctggatttcggtcgccatcaggccggacaccatgtccggttcgcctacacccagagcctgccgcgcctgcaggaagcggtggagcggattgcccgtggcctgcggagctggcaaggctgatgcgttttcatccccccctcgaagaaggtcgcctggtccgtcgttacaagcgttttctcgccgatatcgagaccattggcggcgagttgctgaccattcactgtcccaacaccggttccatgttcaattgcatggtcgagggcgggcaggtctggttcagccgttccaatgaccccaagcgcaaattgcccgggacctgggaaatcagcgaaacgccccaggggcggctggcttgcgtcaatacggcgcgggccaacacgctggtggaagaagccttgcacgccggggtgatcgctgagttgaacggttttaccgccctcaagcgggaagtgccctatggccaggaaaacagccgtatcgacttccgcctggactatctgggcggcccggctttcgtcgaggtcaaaagcgtcaccctgggcttcgacggctccgcggtcgcggccttcccggatgcggtgacccagcgtggcgccaagcatttgcgggagttggcctgtctggcgcgggacggtattcgggcggtgcagttgtattgcgtcaacctgtcgggtgtcgaagcggtgcgaccggccgaagagatcgaccccggttatgccgcggcgctgcgcgaggcggtggcgtccggggtcgaggtactggcctacggggtgcgcttgaccgccgaggaagtgtgcatcgaccgtcgtctggacgtattgctcaacggctaaagctgaacccagatgccctggctgtcttcccggcaggggatggccgtcagggattgcccggcacaggggccggcgacgcattcaccgttttcgatcagaaacagcgcgccgtgggtggcgcactggatcaggctggcgctgggatcgaggaactggtcgggttgccactccagagcgaccccgcgatgggggcagcgattggtgtagacgtagacttgtcgatcgcggcgcactgcaaaaagcggttggccttcaaggttgaaacctcggctggaagcctctggcagatcgccgggggggcaaagaaacttcatgtctatcctcggtaaccaaaggctctgggctcaggctgtcacagttttcctgtgggcgcttggtgaaacatgtctgtgcttgacggtcaaatgcaaacaattatcaaatggccgcttcgcctgtggggcgcttgctcatttcgatgcctgggttgcagggcatgtcacatgtacggcggtttccgtgggcccactctctgaaggaaatacctttatgcgttcgagtgcccgcgcaatcgcgctctgtgtcggacttctggccagtcatgccgctgcggcggccgagctaccacaacgctgggtgagcgccggcggcgccttgtccgaatgggtgagcgcgctgggcgccgaatcgaagctggtgggcgtggacaccaccagccagcatcccgaatccctgaagagcctgccgagtatcggttatcagcgtcagttatcggcggaaggcattctcagcctgcgcccgcagattctgctgggtaccgaagagatggggccgccgccagtgctctcgcaggtgcgcggcgccggggtgcaggtcgagctgttctcggcccaggccgacctgccgaccctgcggggcaacctgcagcatctgggcaagctgctgggtagcgaagacaaggcgacgcagctgttcgagcaataccagcagcagctggagcagcagcgggcctgggtcagccgggcccagaagaaacaggccgcgccgggtgtgttgctgttgctcgggcatgcgggtggcaagcctctgattgccggtaaggacactgccgccgattggctgctgcagcaggcgggcggacgcaatcttgcgacccacacgggttacaagcccttttccaatgagtcgttggccgaactcaaccccgaggtgctggtgtttgccgatcgcagcctgagtggtgaggcggcccgcgccgcgctgttcaaggagaacccgattctcgcctccagcggcgcggccaaggccggccgggtcttcgagattgatccgaccttgctggtgggaggcctggggccgcgcttgccacagagcctgaaaaggctgtcggctggtttctatccagccgagtcaggccaggccagcaccgcccaatgacccctttgcttaaaccccgcacgttgttcattggcctgagcctgctgtgtctgttggcgatctggctgtccctggcgctcgggccggtcagcctgccgttgctcgataccctgcgtgccgccctgcgtttgctgggcctgcctatttcagggcaggggctggagcaggccgaactgatcctcgggcagattcgcctgccacgcaccttgctggggctggccgtagggggcgtcctggctctgtccggcgtggcgatgcaggggctgtttcgcaatcccctggctgatccggggctggtaggcgtctccagtggcgcggcgctgggcgcggcctttgccatcgtcggtggctcgttgctggggggcgtgccggaagcgattggtccatacctgctgtcgttctgtgccttcctcggtgggttgatggtggcgtggctggtctaccgcttgggacggcgcaacggccagacccatgtggcgaccatgctgttggccgggattgcgttgacggcgctggctagctcggcggtgggcctgttcacctacctggccgacgacgcgaccctgcgcaccctgacgttctggaacctgggcagtctcaacggcgccagttattcgaggttgtggccgctgctgttgatcagcgcggccgtggcattgtggctgccacgccgggccagagccttgaatgccttgttgctgggtgaatctgaagccggtcatctggggatcgatgtcgaacggctgaagcgggagttggtgttctgtaccgcgctgggggtcggcgcggctgtcgccgctgccgggctgatcggctttgtcgggctggtggtaccccatctggtgcgactgctggcgggacctgaccaccggaccttgttgccagcgtcgatactggccggcgccagcctgctgttgctggcggatctggtggcgcgcctggcgctggcgcctgcggagttgcccatcggcatcgtgacggcctttataggtgcgccattctttctgtttctcttgttgcgagggcgcgcctgatgctgcgagcggaaaatctggcggtgcgccgtggcaggaaaaccgtgctggaagggatcgaccttgagctcaagcccggggaagtgctgggagtgctagggcccaatggcgcgggcaaaagcaccttgctggcggccttgtgcggcgagctgaaacccgatcagggtcaggtctggctggatcagcgtgagctctccaggtgggacggcgggcaaaaggcgcaaaggctggcggtgttgccgcaaagttcgacgctcgagttcgccttccgggtcgaagaggtcgtgggcctggggcgcctgccttatcaaagcggtcgggcacgggatgatgagattgtcatgcaggccctgcaagcggcggatgccgggcacctgcacggtcgcagctatgtggccttgtcgggcggcgagcgtcagcgtgtgcatctggcccgggtgttggcgcagctgtggccgggcgcggtcggccagaccctgttgctcgacgagccgacctcggccctcgaccctttgcatcaacatgtcactttgcaggccatccgcgagtttgccgatcgtggggtcgcggtcctggtgatcctgcatgatctgaacctcgccgcgcgatattgtgatcgcctgttgctgctcgaaggcgggcggcctcactcgctggacagcccggcgcaggtgctgcggcccgaaccgctcaaggcggtgttcggactggaggtgttggtgcaggcgcaccccgagcgcggccaccctttgatcatcgcccgctgaggcgattcgcggagacgccacatgcgtgtgttattgatcctgagtgtgttgctgctgggcgcctgtgagggcgtgccggtcatgcctgaacttccggtccaggttgaaagtggggcgattcaggacctgcgcagtggaaagctcctgactccagaggagctggtcattcgtctggcccgggcgccgcgggtgattgtcggcgagcagcatgaccaccccgagcatcacgccttgcagctgtggttgttgcaggagatggcgacccagcgcacgcaaggcagcctgctgttggagatgctcacgccggaccagcagccgcgagtcgacgcgctccgccagcacaaggcggcgcagggcttgcccgatgatctgccaggtgcattggcctggtcgccggggtgggactgggcgctgtacggacctgtcgtgcgctatgcgttgctccagccttatccgttgctggccgccaatctggatagctccgaagttcgcggcatctatcgccaggcaccagccttgagtggcgagcactcgaatgccgcgtctgtgcgtaacgagctattgcagcaggttcgtgactcccattgtggcctgctgcccgaaagccagatgccggcgatgctggcggttcagcagcagcgcgaccgacgcatggccgagcgcttgctggcggcaccgacgccggcgctgctgtttgccggggcctttcatgcacgcaaggatgtcggggtgccggttcacctgcgggacctcgacgcatcgaacggcaccgtggtgctgatgctggcgcagaagggcacgcaggtaccgccgcaaagcgcggattacgtgtggtacagcgcgcggttgccggagaaggactactgcgcccagatgcgccagtaggcggatggctttttccggacaaaaaaagacccggcaagagccgggtcaaataaccgtgattagcctgatgaggagataatctgagagtccgaaccactggtcttccaggttatcgactgatctcgcgaccagttgtgataatcataacgattctcattttcaagtcaacaaagtttttcctgtccctgcgaattccgccaaacgctcgtttgaattgcccgtaagttcggggctttaaaggttggtgctcaggctgtgcaggcggctgacttccttgttcaacaagtcgattcgccgcgccatgctttcgatcaggctatgggcgatacgtggattgctctgggtcaggctgagaaactggctcttggggatcagcatcagggtggatggctcgctggcaatcacgctggcgttgcgtttctccccggtgaaaatggccatcgcaccaaagatctcgtccttgggcacgtctccgaccttgtgtccgtcgacgaaggcttcggcgtgcccttcgataatgacgaacacatgatcggcgtcgtcgccctggcgaatcagcacctcgcccttggccacgcgttgaaagccgttgctgttgcgcaactcgggctgcttgaggcgggcaacggcatcggagagcagggcggtttgtccgatcaggtactgtagaaacagttcggaacgctgttcgtcggcatacagatgctggaacaccgcggaacgctgataggggatcaggctcaatggctggttgctgctgagttgccagtgaggcaggtccacgcctcggcgcagcccgagcagatcgccttcatgcagataaaacagtgggcgctcatcgacgctggcttgtacctggccgctttcgagcaggaacaactggctgtcggcaaggctgctggagaggtctttggaaggggccacctccaacacgtcgccggacggcagcaggccttccagcaggcgcggcgggatgctctgcagccgattgatcaaggcatcagcgtaagccggttgttcccccagtaaatacataaaaagcctgccaggtcagttcttttggcgtgaagaaatggcatccagctgtttgttgagtgcttccttgcgttctgccggaatgtcattccagtgcacatccatcagtgcgccttcaatggcgtacaacagcaccttcgaggctcgaaaccctcgggtccgtacggcccgataggcatccaccgcccccaggcggcgcaagtccgaagcgctatggatgcccaccgcatgcagccattgtgccgacgtcttgccaaggttcttcaggtgttgcaattcatcattcatcaagcctccttgcgacggccgaatggtgcgtgggcaagtctcaaaggagtgtagcgctcagtaggaaaagcgctgttctttggtcggttttggcgcaaaagcttctaaggcgacagaggaaagtacgccagaaacagagggaagagggggaaggagaagaccaagtccagcgtaaggcagaaagcgccggacctcggagcaaaaaggagcgattacttggtgcggtagcgcagacgagtgccgaaattgacggacatcaggatctcatcggcagtcagttcgggcggaaagtaggcgccggagatttgcgcatgggccaggctggcgccttccatggaggaattgcgcaggtcgaggccgcgcaggtcggcagagcggaagtaggcgtcggtgaagtcgatgccatcggcgttcagttcacgtaggtcgagcccacgaaaatcgccgccgcgcatgtcgacagtctggtctttcgggcgttcccggttaaagccgtcgatgtcgtctttgtgcagcaaagcgtaaaggggagtatcgagaagtttgggctgactcatggggcgtcacctgctggaattatgacgccagtatagtgccactatttttcagccgtgaagcctttgcggtttcacggctgaaatagttgattacaagcctgggagacgctggcgaatgttcgcgaccaggctgtcgaggctcccgctttcattggtctcgacgcgcttgctgcgcagcacttcctcagcgctcagggcttcgcgattggcttgctgctgttcgattacggccagggtcgcgtccgacgggtcgttgcgatcggcctggcgttgcgccagccagctggcaatgacggcctgcggggcattgcaatcgatgatcaggcaaggcgtgccggtcgcttcggcaaccttggccgcggcatcacgctggtcgcgcttgaggtaggtggcatcgatgaccaccgggaaaccggcgcgcaggacgataccggcaagttcatgcaggcggtcataggtcgcggtattggcttgggcattataaatgccggcattcggatcgttctgtacctgctgctcgccgaacaggcgtttgcgctcgacatcggagcgcaggcgaacggcgcccagggcttccaccagacgcatggccacatggcttttgccaacggcggaaacgccagaagtaatcgccaggaagcgcgatggaatggtgctgtagctttctgccaggttggcgtagttgcggtactggcgcagggctgtggcgcgctgcatcggactggcgtcggccggcatgctgaacagggcgaccttggcgcgtaccagggcgcgataggctttgtagaaattcaacagctccaggccctgatagtcaccggtctgttccaggtactggctgatgaagcggcgtgccaggcatttcaggccgcggtcttccaggtccatggcgaggaaaccggcgtcggcatagacgtcagtgaagcggaacggctcgttgaactcaatgcaatcgaaaatcaccaccttgccgtcgataagcgttgcgttacccaggtggatgtcgccgtggcattcacggatgaagccttcgctcttgcgctgggcaaggagtggcttgaggcgctcgaagctgctttcggcccaggcttgcagggcttcgagctgttgcaggtcggccttgtcgctgaggaatgggcggatctgctcgaagttctgacgcaccggctccatgacgctttccggggtgccggcttcgtgggctgccgggacccgcggggcttcgaggtggaacctggcaatctgccgggccatttcgtcgatgtgcgcggtggtcagttcgccattggcttgcagcgtactgagcagctggctttgcggaaactggcgcattttcagggcgtattcgataaccgggccgtcacccgcgatctgcggcgcttcggcgctgccggtgatcggcaacacttccagatacaaatcatcggtcaggcgctggttcagacgcagctcttcgccgcagaagtgcccgcgcgcttcaaggtcggtgaaatcgagaaagccgaagttgaccggctttttcagcttataggcatagggaccggtgagcaggacccaggaaatatgggtctcgatgacctggaaaccgtctacgggatgcgggtagagggccgggttttgcagggcggcgatcagggattggctcacaggcgatccttcagagtcggggaaaattcaagggcgtcattatggccgctgacagggctaacgcaaacctcgggcggctcctgttgacgatgaataaagtgcgtataatccgccgccatgactcgtactcgatccccccgttccgctaaaaaacgtccgtctagtggcccgcgcccctggctgggctgggccttgaagctcggtctggtcgctttggtggtgctcgccggctttgcggtttatctcgacgccgtggtccaggagaaattctccggcaagcgctggaccattccggccaaggtctatgcgcgcccgctggagctgttcgtcggacagaagctcagcaaggacgatttcctcaccgaactcgacgcactcggctatcgccgcgaaagcgtggtcaatggccctggcgctgcgtcggtcagtggtaacaccgttgaactcaatacccgcggtttccagttctatgaaggcatggaacaggcgcaaccggtgcgggtgcgtttttccggtgactacgtggccgagctgtcaggtagcaaaggctcgaaactggccgtggtacgcctggagccgctgctgatcggcggcctgtatccgaagaatctcgaagaccggatcctgatcaagatcgatcaggtgcctccttatctgctggaaaccctggtggcggtcgaggaccgggatttctacagccactttggcgtgtcgcccaagtcgatcgcacgggcggtgtgggtcaatacctcgtccggcgccatgcgccagggcggcagtaccctgacccagcagttggtcaagaacttctacctgaccaacgaacgcagcctgagccgcaagctcaccgaagcgatgatggccctgctgcttgagctgcattacgacaagcgcgagatcctcgaggcgtacctcaacgaggtcttcgtcggccaggatggccagcgtgccgtgcacggtttcggcctggccagccagttcttcttcagccagccgctggccgaactcaagttgcatcagatcgccttgctggtggggatggtcaaggggccgtcctattacaacccgcgtcgttatccggagcgcgcgctggagcggcgtaacctggtgctcgatctactggcgcagcagggtgtggcgacgccggagcaggtcgaagcggcgaagaaaatgcccttgggcgtaaccaagcgcggcagtctggcggacagctcgttcccgggcttcctggacctggtgaagcgtcagctgcgtgaggattaccgcgacgaagacttgaccgaggaaggcctgcggatcttcaccagcttcgacccgattctgcagatgaaggccgaggcttcggtcggggataccttcaagcgcctggccgggcgcaagggatcggatgaagtcgaagcggcaatggtggtgaccaacccggaaaccggtgaagtccaggccatgatcggcagccgccaggccggttttgccggtttcaaccgggcgctggatgcggtgcggccgatcggctccctgatcaagcccgcggtttacctgacggcgctggagaaacccagccaatacaccctgaccagttggctctccgacgaggcgttctcggtgaaggggggcgacgggcaggtgtggagaccccagaactacgaccgtcgttcccacggcacggtcttcctttatcaggggctggcccattcctataacctgtcgaccgcgcgcctgggcctggaagtcggtgtgccgaatgtgctgaaaaccctggggcgccttggtgtcacccgcgaattcccggcgttcccttcgatgctgctgggggcggggggcttgagcccgatggaagtcgccaccatgtatcagaccctggccaacggcggtttcaataccccgatgcgcgggatccgtagtgtgctgaccgctgagggcgaaccgctgaagcgttatccgttccagatccagcaacgtttcgacccgggttcgatctacctgatccagagcgcgatgcagcgcgtcatgcgcgaaggtaccggcagttcgatctacaacgtgctgccgcgctccctggcgctggcgggcaagaccggtaccagtaacgattcccgcgacagctggttcgccggtttcagccaggatctgctggccgtggtctggctggggcgtgatgacaacggcaagacaccgttcaccggcgccaccggcgcgttgcaggtctggaccagtttcatgcgcaaggccgacccgttgccattggatatgccacaaccggataacgtggtgcaggcctgggtcgactcgcggaccgggcaaggctccgatgccaactgtccgggtgcggtacagatgccgtatattcgcggcagcgaacctcctcccggtccggcatgcggtggcgaaagcccggcgtccggcgagtcggtgatggattgggtcaagggctggatgaattaagcgaagagggtttgacgtgaacaagtggtggattccagctattacagctctggctttgctcaatggttgcgccagcgtgcagcgtggctcgattccggtggtggactccggtaccgcagtgtccaacagcgaacgcatttcggccaatggcggcttccgtcagacgactgtcaagcgtcctgcgcaagctcagactcaaagtattccccaggactcgggcgtggtggtgatggtgccgggcggggctgcggccactgctgcgccgattagcagcgcgccgattaccccgggcccgatcaccccaggtcctatcgataccgcaccgatccagtccgcgccgatcaatcagggcagctacagcttgccgccgacgccgagcggggtgccttcggccagctctggcgggctatccgccgatgagcaactggacggtccagtgctggccctgttgaccaccgctcagcagcaacaggcgagtggtgatctgaacggtgcttcctccagtcttgagcgcgcccagcgtgtcgcgccgcgtgagccgcaggtgctgtatcgcctggcccaggtacgcatggcccagggcgatgccccgcaggctgaacagtttgcccgtcgcggcctgagcttcgccaacggtcgtccggatctgcaggccagcctgtgggcattgattgcccaggcacgcgagaaacagggcgatgccgctggtgccgctcaggcccggcaaaaagccaaggtgtcgctctgatggatgcacgttttccaaagattgccgatcagttgctgttgatcgagcgtgagatgcggttacaggggttgtgggatgacactccgccgagtgccgaagcactggccagtgtcgagccgtttgccgtggatacgctggagttcgagcagtggctgcagtggatcttcctgccgcggatgaaggcgattcttgaacaggatctgcctttgcccaacgcctcgggtatccaggaaatggccgaagtggtattcgccggtcgctcgatgcaaggccgggaccatcagttgcagatcctgctcaaggagtttgaccaactgatcggcggcgcccgctaaaccttctgcaaccactgcctagcggcagtggttgtctatcgccttctgtgtttccgcaatgcgctgctgccgttgttcctcggtcaggcggcgtattccaccctctgtgttctcgctcaggcgcgggttgttctgcaactgcgccaggctggcccgtgcctgtgtgcaaaaacgcctgcgttcggcttcctgcctggcgagctgcttgacctgattgtccatgacttgttgctgagggcccggcttgtcgggcggcggagtactgctcgcacctttcggcgcttttggcagggtgatggcagtgctggccacgccttgagggggcagggcgtcgaaatgggtgactccctgggcgtcgacccatttgtaaatctggccggcctggcacgggaggctcatggcgagcagcagtccagcggtcatggcgaaggttcgcatttttgaattccttatccaggattgcgcaattgaagcgcagacactcgcggtttacaggttttttcttgcgttctcatgcgcttagttcgaataaagcacattgacgtcttgacttgcagagggcgaaacagaagaatccaaagtccgctgtagagggactgccagaagcagacccactcggcagaacatgaggcgcacatccgcgccgacctgctacacccgcaacgcgttacctcgcgctgggtgggaaaaccccgcaacacttggggcactcccaatacttgctcagtcagtgctgacgtagtcggcgaccaccgtcgctcatgctctgctgagaagtaaacctattaagacccgtcccctttcaagagggcggtattctggcgttttagaggtgaacaacgtggagcttttatctggcggtgagatgctcgtccgctttttgcgtgacgaaggcgtcaaatatatctatgggtacccgggtggtgctctccttcatgtttacgatgccctgttcaaagaaccggaagtgacccacatcctggttcgtcacgagcaagcggctacccatatggctgacggctacgcccgtgccaccggcaaggccggcgtggtactggtgacttccggccctggcgcgaccaatgccatcaccggtatcgccactgcctatatggactccattccaatggtgatcatttccggtcaggtgcctagcaccatggtcggtaccgacgcgttccaggaaaccgacatgatcggtatctcccggccgatcgtgaagcacagcttcatgatcaagcatgcttcggaaatcccggaagtcatgaagaaggcgttctacctggcgcaatccggtcgtccgggtccagtcgtggtcgatgtccctaaggacatgaccaatccggctgaaaagttcgaatacgttttccctaaaaaagcgaagctgcgctcctacagcccagctgttcgtggtcactccgggcaaatccgcaaggcggcagaaatgctcctggcggccaagcgtcctgtgctgtacgcaggcggcggggtgatcctcggtggcggttccgcgccgctgaccgaattggcacaaatgctcaacctgccggtcaccaataccctgatgggcttgggtgcctatcctggcaccgatcgtcagttcgtcggcatgctcggcatgcacggcagctacaccgccaacctgaccatgcaccatgccgatgtgatcctggcagtcggcgcgcgtttcgacgaccgtgttatcaacggcccggcgaaattctgcccgaacgccaagatcatccatgtcgacatcgacccggcgtccatctccaagaccatcaaggcagacgtgccgatcgtgggtccggtagagagcgtcctgaccgaaatggtcgcggccctcaaggaaatcggcgaaaccccgaacaaggacacagtcgccagttggtggaagcagatcgaggagtggcgcggtgatcgcggcctgttcccttacgacaagggcgacggcagcatcatcaagccgcagaccgtgatcgagaccctctgcgaagtgaccaagggcgatgcctatgtgacctccgacgtgggtcagcaccagatgttcgcggcgcagtactaccggttcaacaaacccaatcgctggatcaactccggtggcctgggcacgatgggcttcggtttccctgcggccatgggcgtcaagctgagtttccctgatgctgacgttgcctgtgtaacgggcgagggcagtatccagatgaacattcaggagctgtcgacctgcctgcagtacgacctgccggtcaagatcatcaacctgaacaacggtgcgctgggtatggtgcggcagtggcaggacatgaactacggtagccgtcactcgcattcctacatggaatcgctgcctgatttcgtcaagctggccgaagcctatgggcacgtgggcattcgcgtcacggacctgaaggatctgaagccgaagatggaagaagcgttcgccatgaaagatcgcctggtgttcctcgacatccaggtcgataccagcgagcacgtctacccgatgcagatcaaagacggctccatgcgcgatatgtggctgagcaagacggagcgtacttaatcatgcggcacattatctccttgcttctggaaaacgaaccgggcgccttgtctcgtgtggttggcctgttttcgcagcgcaactacaacatcgaaagcctgaccgtggcgccgactgaagacccgaccctgtcgcgtctgacgctgactaccgtggggcacgatgaaatcatcgagcagatcaccaagaacctgaacaagctggttgaagtggtcaagctggtcgacctgtcggaaagcgctcacatcgaacgcgagctgatgctggtcaaggtcaaggccaccggcgcccagcgcgccgaggtcaagcgcaccaccgatatttaccgtgggcagatcgtcgatgtcagtgccagcgtgtataccgttcaattgaccggtaccagcgacaagctcgacagtttcatccagtcgatcggcaccgcctcgattctggaaaccgtacgcagtggcgtcaccggcattgcccgtggcgataaagtactcagcatctaactcaaattagcgaacggcctgaacggcctgatataggggaaattcatgaaagttttctacgataaagactgcgacctctcgatcatccagggcaagaaagttgccatcatcggttacggttcccagggccacgctcaagcgtgcaacctgaaagactccggcgttgatgtcaccgttggcctgcgtaaaggttcgtccaccgttgccaaggctgaagcccatggcctgaaagtgaccgacgtagccgcggccgttgccggcgccgacctggtcatgatcctgaccccggacgagttccagtcccagctgtacaagaacgaaatcgagccgaacatcaagaagggcgccaccctggccttctcccacggcttcgcgatccactacaaccaggtcgttccgcgtgccgacctcgacgtgatcatgatcgcgccgaaggccccaggccacaccgtacgttccgagttcgtcaagggcggcggtatccctgacctgatcgctatctaccaggacgcttccggcaacgccaagaacgttgctctgtcctacgcggcaggcgtgggcggcggccgtaccggtatcatcgaaaccaccttcaaggacgagactgaaaccgacctgttcggcgagcaggctgttctgtgtggcggtaccgtcgagctggtcaaggccggtttcgaaaccctggtcgaagctggctacgcgccggaaatggcttacttcgagtgcttgcacgaactgaagctgatcgttgacctcatgtacgaaggcggtatcgccaacatgaactactcgatctccaacaacgccgaatacggcgagtacgtgaccggccctgaagtgatcaacgccgaatcccgtcaggccatgcgcaacgccctgaagcgcattcaggacggcgagtacgccaagatgttcatcagcgaaggtgctaccggctacccatcgatgaccgccaagcgtcgtaacaacgccgctcacggtatcgaaatcatcggtgagcaactgcgctcgatgatgccgtggatcggtgccaacaaaatcgtcgacaaagccaagaactaagttcgagtcttgtcagggaaaaacgcggcctaggccgcgttttttcgtttggatagacaggttctggtataaagctggatcctttgtggtccaatcgtgaccctgggtatcgtcgaaacttttcacaccgttgcaaggtaatgtccatgagcgaacgtcccgaagagccaaaccaggcctctgacgccgaaagcctgctacccatcgatgagcatgtcgaagaagggcatgacgctgaaggccgtaaagtccggcatcgtggtatctatctgctgccgaatctcttcaccaccgcgaacctgttcgccggtttctactcgatcatcaactccatgagtgcccagagcgcattgagcgccggggacgcggcaggagcgagcaagtatttcgcattcgcggccatcgcgatttttgtcgccatggtgctcgacggtctggatgggcgcgtggcccgcatgaccaatacccagagcgcttttggcgccgagtatgactcgctgtccgacatggttgccttcggcgttgcgcctgccttgctggcattcggttgggcgttgggcgacatgggtaaggtcggttggatggtcgccttcatctatgtagctggcgcagcgttgcgtctggctcgcttcaacacccaggtggggactgccgacaagcgttacttcatcggcctggccagtccggccgcggcgggtgtggtggctggtattgtctgggcgttcagcgattacggcatccagggttcgaagatgtcgttcctggtggcgctgatggtggcggcggccggcatgctgatggtcagcaatatcaagtacaacagcttcaaggagctggacctgaaggggcgtgtacctttcgtggcgattctcgccgtggttctggtattcgccgtggtcttcagtgatccgccgcggattctgctgttggttttcctcgcttatgcggcgtccggtccggtgcaatacctgctgcgtcttcgtcgacgcaaaacgttgccttaatgtaatttcccccatactccgcagtctattggtgcatcagtcctccaatactgcggagttgccatgttgatcaaaatccccaagtcgtctgactgcaaagagtcggacgtcacgtctgaatctctttatttctctcgccgtagcctgttgggtggggtcattgctggcctggctgccagtgcgctgccgcgttgggccagtgccggagacgctgggcgctatccagatgtcgaacctggcaaggcgccgtcatggtttgcgcagaaactgccggaaaccaaatggcaggcggtcaacgtcaaggatgaggcgatcactccattcaaggatgctacccactacaacaacttctatgagttcggtgccgataagggcgacccggctgccaatgccggcgcgctgaaaaccgagccctggagcgtggtggtggacggggaggtgggcaagccagggcgttatgcgctggaagacttcatgaagccttatcagttggaggagcggatctaccggctgcgttgtgtcgaggcctggtccatggtgattccctggatcggtttcccgatctccgagttgctcaagcaggtcgagccaacctccaaggccaagttcatccgcttcgaaacccttcaggatcctaaaagcatgcccggccagcgttcgggttttgccctgatcgattggccttatgtagaagggctgcgcctggatgaggcgatgcatcccttggcgattcttgccgtggggatgtatggccgcgagctgcctaaccagaatggcgcgccgttgcgtttagtggtgccgtggaagtacggcttcaagagcatcaagtcgatcgtgcgcatcagtctggtggaggagcagccgaaaaccacctggcaaagcatcgctgccaatgagtacggtttttacgcgaacgtgaatcctacggttgatcatcctcgctggactcaggcacgcgaacgtcgattgcctagcggcctgttcagtcccaacgtgcgtgagacacagatgttcaatggctacgcggatgaagtcgcttctttatataccggcctggatctgcggaagaattactgatgcgctacccactctggcgccttggcgtcttcatcgttgctgctatctggcctttgctttggttgtaccaggcttgggcctccgccctcgggcccgacccgggaaaggtactggttgatcggttggggctggggacactgatctttttgctgatcaccctgagtatgacgcccctgcagaaactcacgggatgggcgggatggatcgcggtacgacgccagttcggtttgtggtgctttgcttatgtagtgctgcatttaagtgcttacgctgtatttatcctcgggctcgactggtcgcagttgggcgtggagttgcgtaagcggccctacattattgtaggaagcctgggctttctcggattgttggccttggcggtgacttccaatcgatacagtcagcgtcgtctgggcagtcgttggaagaagttgcatcggttggcgtatctcattctcgggctgggtttactgcatatgctctggattgttcgggctgatcttaaagagtgggctatctacgcctctattggcgggttgttgttactgctgcgggtgccgccggtgacacggcgaatcccgcgtttagtgggaaaaaatcatcttttgcaacaaaagcgtaattaggggttgacggcagattctggaagtctataattcgccccacttccggcgcagtcgaaacggaaaactccttgagattcaacgagttacacggttttcgacagcggccacgcttcagttcatcgaagcccgaaggagttgattcggcagtatgttttcgccgggttaacgattcgatcttctcggtcgaaagcggagaaaaagaggtgttgacagcagcgtgtaacgctgtagaattcgcctcccgctgacgagagatcggaagcgcaagtggttgaagttgcaaaggaaactttgaaagcttcttaaaataaccgcttgacagatacagaggctgctgtagaatgcgcgcctcggttgagacgaaaggcttaaccaaccgctctttaacaactgaatcaagcaattcgtgtgggtgcttgtggagtcagactgatagtcagaaagattatcagcatcacaagttactccgcgagaaatcaaagatgtaaccaacgattgctgagccaagtttagggttttctcaaaacccaaagatgtttgaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttgcctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgacatcagctgcttcataagctcccacacgaattgcttgattcattgaagaagacgattgggtctgtagctcagttggttagagcgcacccctgataagggtgaggtcggcagttcgaatctgcccagacccaccaattactggtgcaccctgtagcgatacggggccatagctcagctgggagagcgcctgccttgcacgcaggaggtcagcggttcgatcccgcttggctccaccattacagattggtgtccatcgtttaaagcttagaaatgagcattccatcaagttgatggtgaatgttgatttctgatctttatcagaatcgttctttaaaaatttgggtatgtgatagaaagatagactggatagcactttcactggtgtttattcaggctaaggtaaaatttgtgagtttaatcgcgaattttcggcgaatgtcgtcttcacagtataaccagattgcttggggttatatggtcaagtgaagaagcgcatacggtggatgccttggcagtcagaggcgatgaaagacgtggtagcctgcgaaaaagcttcggggagtcggcaaacagactttgatccggagatgtctgaatgggggaacccagccatcataagatggttatcttgtactgaatacataggtgcaagaggcgaaccaggggaactgaaacatctaagtaccctgaggaaaagaaatcaaccgagattcccttagtagtggcgagcgaacggggactagcccttaagtggctttgagattagcggaacgctctggaaagtgcggccatagtgggtgatagccctgtacgcgaaaatctcttagtcatgaaatcgagtaggacggagcacgagaaactttgtctgaatatggggggaccatcctccaaggctaaatactactgactgaccgatagtgaactagtaccgtgagggaaaggcgaaaagaaccccggagaggggagtgaaatagatcctgaaaccgtatgcgtacaagcagtgggagcagactttgttctgtgactgcgtaccttttgtataatgggtcagcgacttatattcagtggcgagcttaaccgaataggggaggcgtagcgaaagcgagtcttaatagggcgtttagtcgctgggtatagacccgaaaccgggcgatctatccatgggcaggttgaaggttaggtaacactgactggaggaccgaaccgactaccgttgaaaagttagcggatgacctgtggatcggagtgaaaggctaatcaagctcggagatagctggttctcctcgaaagctatttaggtagcgcctcatgtatcactgtagggggtagagcactgtttcggctagggggtcatcccgacttaccaaaccgatgcaaactccgaatacctacaagtgccgagcatgggagacacacggcgggtgctaacgtccgtcgtgaaaagggaaacaacccagaccgtcagctaaggtcccaaagttatggttaagtgggaaacgatgtgggaaggcttagacagctaggaggttggcttagaagcagccaccctttaaagaaagcgtaatagctcactagtcgagtcggcctgcgcggaagatgtaacggggctcaaaccatacaccgaagctacgggtatcacgtaagtgatgcggtagaggagcgttctgtaagcctgtgaaggtgagttgagaagcttgctggaggtatcagaagtgcgaatgctgacatgagtaacgacaatgggtgtgaaaaacacccacgccgaaagaccaaggtttcctgcgcaacgttaatcgacgcagggttagtcggtccctaaggcgaggctgaaaagcgtagtcgatggaaaacaggttaatattcctgtacttctagttattgcgatggagggacggagaaggctaggccagcttggcgttggttgtccaagtttaaggtggtaggctggaatcttaggtaaatccggggttctaaggccgagagctgatgacgagttaccttttaggtgacgaagtggttgatgccatgcttccaagaaaagcttctaagcttcagataactaggaaccgtaccccaaaccgacacaggtggttgggtagagaataccaaggcgcttgagagaactcgggtgaaggaactaggcaaaatggcaccgtaacttcgggagaaggtgcgccggtgagggtgaaggacttgctccgtaagcccatgccggtcgaagataccaggccgctgcgactgtttattaaaaacacagcactctgcaaacacgaaagtggacgtatagggtgtgacgcctgcccggtgccggaaggttaattgatggggttagctaacgcgaagctcttgatcgaagccccggtaaacggcggccgtaaactataacggtcctaaggtagcgaaattccttgtcgggtaagttccgacctgcacgaatggcgtaacgatggcggcgctgtctccacccgagactcagtgaaattgaaatcgctgtgaagatgcagtgtatccgcggctagacggaaagaccccgtgaacctttactatagctttgcactggactttgaatttgcttgtgtaggataggtgggaggctttgaagcgtggacgccagttcgcgtggagccatccttgaaataccaccctggcaactttgaggttctaactcaggtccgttatccggatcgaggacagtgtatggtgggtagtttgactggggcggtctcctcctaaagagtaacggaggagtacgaaggtgcgctcagaccggtcggaaatcggtcgtagagtataaaggcaaaagcgcgcttgactgcgagacagacacgtcgagcaggtacgaaagtaggtcttagtgatccggtggttctgtatggaagggccatcgctcaacggataaaaggtactccggggataacaggctgataccgcccaagagttcatatcgacggcggtgtttggcacctcgatgtcggctcatcacatcctggggctgaagccggtcccaagggtatggctgttcgccatttaaagtggtacgcgagctgggtttagaacgtcgtgagacagttcggtccctatctgccgtggacgtttgagatttgagaggggctgctcctagtacgagaggaccggagtggacgaacctctggtgttccggttgtcacgccagtggcattgccgggtagctatgttcggaaaagataaccgctgaaagcatctaagcgggaaacttgcctcaagatgagatctcactggaaccttgagttccctaaagggccgtcgaagactacgacgttgataggttgggtgtgtaagcgctgtgaggcgttgagctaaccaatactaattgcccgtgaggcttgaccatataacacccaagcaatttgcgcttaacagccagattgcggtgtgtgaagacgaaacgaaccgaaagttcgagaaaacacacaaactatcgcatacccaatttgctgaaacgtcgaaagacgcgtcggcacaccgaatttcttgacgaccatagagcattggaaccacctgatcccatcccgaactcagcagtgaaacgatgcatcgccgatggtagtgtggggtttccccatgtgagagtaggtcatcgtcaagattaaattccgaaaccccaattgcgaaagcaattggggttttgtttttgcgcgcggaaaacggttcttatctccaaacaattttgcacagttattttcgggacggacctctagaatagcttcacgccttttcagagccagagccttgtatgtcagatacggttgacgccccccggctgtcggagttgccgctggacgatctggtggcctgccacgaatgcgacttgctgatgcgcaagccagagttggcccacggagaaaaagcccagtgcccccgctgtggttacgagctatatgcacaccgccataacgtcgtggatcgcagcttggcattggttattgccgcgctactgctctatgtccccgcgaactttttacccatcatgcagctcaatctactcggacaatcctctgaggacaccgtgtggagcggcgttatcggtttgttcaataccgatatgcaaggcgtggcggtggtggtgtttctctgcagcatgggtattccattgctcaagctggtctgccagttgctcgtgctcctgagcattcgcctggacataggtcgcagttacggcctgttgctgtaccgcatttatcaccacttgcgggactggggcatgctcgaggtctacctgatgggggtattggttgccatcgtcaagctggcggacctggctgccatgacggtcggcctggggttggtgtgttttgtcagcctgttattggttcaggtgtggcttgaggtggtcatgtcgccccatcagatatgggatgccctggccggggaggatgcgtatgcgggcgattgatgcgggcattctggtctgtaatgaatgccacgagctgaaccggcaggaacccgataccgatgagcagatctgcactcgctgcggagccctggtgcatgctcgtcgccccaacagcatcatgcgtacctgggcactgctgatcaccgcggcgatcctgtacatcccggccaatgtgctgccgatcatgacggtcacgtcactcggccagggtgaccccagcaccatcatgtcgggggtgatcgtactggtgcagcacggcatgatcccgattgcggcggtggtattcatcgccagtattctggtgcccaccttcaagctggtggggattgccctgttgctgttttcggttcagcgccaccagccgttatcggcgcggcaacgcatttggatgtaccgctttatcgagttcatcggccgctggtcgatgctggatatctttgtgatcaccatcctggtggcggtggtgaatttcggccgacttgccagtatcgaggccaatctcggtgcagtggcctttgccagcgtggtgattctgacgatgctcgccgcagtaacttttgatccccgactgatctgggataacacggagtcggacgacgacaatgagtgatttgcctaaagctaaaacccgtccggcttcgaactggtcggccatctgggtcctgcccctgatcgcgttgctgattggcggatggttgggctggcgtgcctacagtcagaccggtatcgaggtccaggtgcgctttgaaagcggcgagggcatccaggccaacaagaccgaggtggtctacaaagggatgtcggtgggcaaggtcaaggccctggccctggacgacgaaggcaacaccagaggggtgattgccactgtcgagatgaacaaggacgtccagcaatacctgaagagcagcacacgcttctggctggtcaagccgagcgtgaccctggccgggatcaccgggctggagacgctggtttcaggcaactacatcgccatcagcccgggagagggcgagcctgctcgcaagttcaaggcgctggccgaagagccgccgttatcggatgccaagccgggcctgcacgtgaccatcaaggcggatcgcctgggttcgctgaaccgcggcagcccggtgttctacaagcagatccaggtggggcaggtgaaaagctacctgctctccgaagaccagaacacggtggagatcaaagtctttatcgagccgacctacgccaacctggtgcgcaaacatacgcgtttctggaacgccagcggcatcagcatcgacgccaacctgtccggtgtgaaagtgcgtagcgaatccctggccagcatcgtcgccggcggtatcgccttcgccaccccggaaaatcgccgggacagcccgccaaccgacccgagcctgccgttccgtctctacgaggacttcgacgcggcgcaggcgggcatccgggtcaaggtcaagctgagtgatttcgaagggctccaggcaggccgcacgccggtcatgtacaaggggattcaggtcggtaacctcaaggccctcaaggtcgatccggatctgtccagcgccacggcggaactgaccctggaccccttggccgaggattatctggtgcaaggcacccagttctgggtggtcaagccttcgatctccctggcgggtatcaccggtctggaagccctggtcaaaggcaactacatcgcggtgcgcccaggtgacaagggcgctgctccgcaacgcgaattcgaggcccggcccaaggcgccgccgctggacctgcgctcccctggcctgcacctggtgctgttcaccgaaaacctcggttcgctggaggtgggcagcccgattctgtacaagcaggtcaaggtcggctcggtgcagagctaccagttttcgcggacccgcaagcagttggtcatcggcgtgcacatcgagaaggagtacgaagggctggtgaacggctcgacgcgcttctggaatgccagcggtgtcaccttgaccggtggcctgaccggcggcatccaggtcaagagcgagtcgttgcaaagcctgatggccggcggtatcgctttcgacacgccggaacccaacgtgccgctgaaaaagcgcatcccacgtttccgcttgtatgccgacaaggagcaggcgacacagaagggcaccctgatcagcatcaaggtcgagcgcgccgatggcctgcgtccgggcacgcctatccgcttcaaggggctggatgtcggcaaggtcgaagacgtcgacctgagcggcgatttgcagtcggtgctgctcaaggctcggatcaccgaggtgccggagcgaatcgcgcgggtcggcagccagttctgggtggtcaagccggaacttggcttgatcaagaccgccaacctggaaaccctggtgaccgggcagtacatcgaagtgcagccggcggcgaagagcctcggcgcgcaaaccagctttgtcgccttgccccagccaccggaagctgcagtcgccgaggccggcctgagcctggtgctgagcgcggcgcggcgcggctcgctgaaggtcggcgtgccggtgacttaccgcgaggtaacggtgggcaaggtcacgggctacgaactgggccagactgccgaccgggtgttgatccatatcctgatcgagccgaagtacgcgccgctggtgcgtggcggcacgcgtttctggaacagcagcgggttcggtatcgacattggcctgttcaagggcgcaactgtccgtaccgagtcgctggagaccctgatccagggcggcatcgcctttgccacgccggatggcgagcgcatgggcaacccggcacggccggaacagaccttcccgttgttcgacaagttcgaggacgaatggctgacctgggcaccgaaaatccccctgggcaaataacccagaaaacaaaaaggccgtgatcgaaagatcacggcctttttgttttacggcttcgggcgggttacacctcgtccagctccgcttcggcttctggctcgacgttcagggtggccttgacctgatcgtgacggcggatgtacttccagtccgcctcgtcgatgtagataccgttcgggccgctgccaccttccaggtcgatggcgacctgggccgacacctgcggcttcacactggccaggatcggcacgaagcccagttgcaggctggtttccagcagcgctgcctggttcttctcgtcgatgtccgcggcctcgtcgaggtagtacggcaggcggatgcgcccggcctgctcgcggtccatcaagtgcagcaacaggtacatgttggtcagcgccttgatggtcatggtagtgccgttggacgccgcgccatcgatatcggtgtggatcaccggctggccattgaccttggtgatctcgaacgccagctcgaacaggtccttcaggcccagctggttatggttggccgctaccaggcgggccaggtattccttggcctcttcgttcttgctgtcctgttcggcgctctggctcaggtcgaacaccgacagggtctcgccttcttcgtactggccggcgctgtgaatgatctggtcgatgtgcttgagggcttccttgttcggcgcgagcacgatacggaagctctgcaggttggacacctggcgtttgttgatctcgcggttgaacagcgccaactgatgctcgaggctgtcgtagtcgctgcggatgttgcgcagggtccgggcgatgtcggtgacggccgcgcgacgcgccttgcccagggtcagggcttcgtcggtgcggtgcgcataagcgttgatcaacagttgcaggcgacgctccatgtcgtcttcgctgtcgaacttggccacgcccttgaggcgcacctgggcgtacagcgcctcgatctggccatcgacccgctgcaggccctgccagctgtcctgatagtcgttgagcaggggcagcaggttgtccatggagtcgtccaccggctccatgaacggcgtgccgaacggcaggtccgccggcaacagctggcgacggcgcagggcatcgtcgagggtgcgttgcttggcttccatgtcgccgatctgccggcccaccagttgcagcttggccgacagctgctggacgcgttcggtgaaggcgtcgctggagcgcttgagttcgtcctgggcggcttccatctgcgccagctgttccagcttttcgccttcctcggcgctcagggtctgcgcgcggcggaagtcttccagggctttctgcgcatccagcacctgctggtacagcgcttcggtctgggtcttgctcgcggcgcggtcggcggccaccgcggcctgggttttcagctgcttgagttctttgtccaggcgctctttctggtcgcgcaaggccgcgcggtccgccagggcctgcaaggccggtggctcgatgtgggaaatgtcgatggacagccccggcacttcgaagcgctcgcccttgaagccatcgaggatcagctccacggatttgacccagtcgccgttctcgtccagggcgatgccgtgttcgcccagcggcaggctgaacaactggctgttgaacaggcgcatcaggcgctcgacgtcctgttgcgagaattcctcgcgcaggcgcgcatagctgttgttgtcggcgttatcgagctgctgcttgaccgacttcaggcgtttttccaggtcccgcaggcgctcttccaggtcctcggcggagaactgccgggattgggccagggcgccggccagttcgtcgtgggcatccttggccgccagcagttgctgctccaggaccttgacgtcatctaccagggcgaaacgatgcttgagcaccgagagctcgccgagccagcgctgggtgccggtgatttcccgctccaggcgcatcatttcctgggtgctgctgcgctggtcgttctgcagtgcgtcctgttcgttgcggtagtgctcggcctggatggtcagctcttccttgcgcgcgctggcgtagtcggaccaggtgcccagcagcgagtcgagcagcggcgacaggcgatgcagtttgccgcgcaggatgtcgcgctgtgtcacgccgttggccagggcttccaccaggggacccgcggccaccagcgagttgtagtcctgctccatgcggcgcacgtcgcggaaggcgtcttcgcaggcggcgatgtagtcgacgctgccggagcgcaagctgtgctcgaaggcatcgaggaacagctgcttgagcttggccgcggtgatttcgcgcatgtgcagcaggttgatgaatagcgcgcggaaggtcttcaggctctgctcgctggtggagcgcagcgggatcagggtcaggtccagcggaatcgaggtatgcccgcccaccagcagacggcgcagttcatccggcttgagttcataggccttcaggccctggcgctcgaggttggtgaacagctctttctgccgcaggcaggtgtcgtctttctggtagtgcgccaggtccagcgagccggcataggcgaagaactggtgaccgaaactgccgcccggaccgcgcccggccacgccgatcacatgcgggccatggggcagggacacttccaccaggatgtagctggtatcggtggcgaagtagaaacgccgcgactgttccaggctgtacttgccgaagctcatgtccgacatgcgtgccaggatcgggaattgcagggcgttgatcgaagcggacttgcccaggttgttcgcgccgtagaccgacagcggttcttccagcgggaacaggcccaggctgtagccggcggtgttcaaaagggcaaagcggcggatgccgtagcgttccttgctcatgcgtcgagctcctgttcttcggcaatggcgcgggccagtgcgtcctcttcactttccgattcgacgaattcgctgaggtccagcgggtcgtcggtctgcagcagtttttcgtcgctgtcttcgtcgatcagcaccggcgtcggcaacggcagcacgctgtgcaggctggcggccaggtcacggtcctgctgcaccgacaggcacacatcgaggaagcggtgcatcggcggcaggaagcggtagatgcccggctcctcgccggcaaaacccagttgggtcatgcgccgcatgattttttcttccagttcttcatgggtctgcacttcggcctggatgaacaggtcgcggtacttctccagcaaggacggcagttcgtcgcggccgaggctgccgccgtcgagcacggcgaccgggtcgcggccctggtcggccaggtgctccaccaggatgaaggtgaacagcgccaggcgctgggcggtcttgttcacctgggcggcggcgttctccggcacgaagtagtagaaaccacgggtatcgcacaccagttcgaagcccagggccttgaacagggtgcggtactggtcctggaagttcgacagctgggagtacagctcggggtcgcggcggctgacgtgataacccttgaacagctcgcgaaagatcggcgccagctgggacagttcggaaagatcaagatgcatgtggagtgctcgcagaattctcagcggcgtcatcgcgggccgagagcagggcgaaggagcgcaggctgacctggtgctcgtgggtgtggtagtcgcggcgttccagacgctcgcgcttgaagcgtttttcccgcgacaggcgggagaaccagtacagcagctcgtcggtggcgccgtccggttcctgttccagcagccaggtcatcaggtccggcatcggcagggcatcttcgcagcggtcgagcatctcgcggaccgtacgtggcgcccgtggcgcattgccgcccttgtgggtcttgtgcgccttggggaagcgcgtcggcttcggttcgaagctggccagcgcatagacataagcctcgacctggccggagctgccgaggaaggtgctttgtggacgggtgaacagtggcatggccgcttgcggcacggcgtcgatgcccttgcgccggatggccgacagggccagggctgcgccgcgggtcacggcgttgtgccggcgggcttcttcacgcagcggcagcagcagttcccgggcgtgacgcagggtcagctgggcgctggtctgcatttccaggatccgcgcgtgggtgcgcagcagcatgtcgtcgtccaccaggtggcccaggcgctgctgttcggtgagcatgcgcagcaggacgttctcgaccttgcgcacgccttgctcgaaggcgccatcggcgttcaccagctggatcatcggctcgacgtattcgtcccaggtggccagtacctcggcgtaccgctggcgcaggggaatctgccggtcgctggtcttggcccgctcggcgacggccaccagggcctgttcgtcgttggcgagctttttcaatacatcgcgcacgcgcatgtccagcaaccgcagctggcgggccaggtcatggccgtcgcggatgtcgaaggcgtcctggatgtaaccggccaggcgttcgaggtggcgcaggtaagcttcgatttccaggcacaggcccaggcggtgctcgcgccgcaggtaggcaaggaagtcatggatctgtgcgttgagctcgaaacgattcgggcttttcgccaccggaaccaggatatccaggcggatccacacgtccagcaggctggtaatgtcctgtggcgtactgtcaatttgctgtgtggccagctgtgaacgcagttcggcgaggctcagggtgccttggtcgaagtgctcgcacagtggctccagaagtgcccagtgttcggcgagggcgcgcaacacgcgcttgggttcgatcatcggaatggccggctggttggcaatgaaaagcagcgattgtactgcatcggaaggccgacgattcacccctcggtcttgtcatgggctggaccggtgtttttgtgacgaatcaactgcgggcgatcttcggcgaaggacggtagaatccccccacttcagttatccacaagtggccgacctttgcttatcgagtcccgccgtcgcgcttatctgtccgccatgcaggtggtcagctggctgccgcgtaccgaattgccctttgcggcgccgtcccgtcccgagttgctggtgattgccgagcccgtggtcgaggccccggcagcccctgcacctgtggccaaaacggttgccgagcctgtggccaagcctgccgaacggccgaaaatcgaagtgccgcgtcccgccggcgctgccgttcgtccggtcagcaagcccgtggtcgatgccgaggaagccccggcgccggtcaaggccccgcccgtgccgccaccgcgtttcgccctgcaattgctgcgcgccggtcgttgcctgctgctggtggagttacccacaggtgaagccttccagagccgcgacccggcctatctgctgctcaaggacatgctgcgcgccgccggcctgccggacagcccgcagattctcgccgagccggtgcgctggccgatgctgacccgcggcaatctcgaccaggggccggacgcggcacgggatttcgtccaggcctttgtcggggcgcgcgtcgaagaagaaccttgtgtctgcctgtggctgatcggcctgccggcggtgcgtttcgcgggcgaggctgatgcgcagtcctacaaccgtgaactccaggtcgaaggcctgggctcggcctgggcgctgcctgggctggaactattaatggaagagccacagcgtaaggctgatgtctggcaagccatgcgtcggctgatggcgcgttggaaaagtagcaatgagtgacgctttatcgttccgccaggccaccgaggcggatctggatgccatcctgaaaatcgaatacgcggcgttcagccatccctggacccgcggcattttcaccgatgccctgaagtcctatgaagtctggctgatgttcgaaggcagccagcaggtcggccacggagtgatccaggtgatcatcgacgaagcccacctgctcaatatcaccgtcaagccggaaagccagggccgtggcctgggcctgcgcctgctggaagaattgatgaagcgcgcctaccagaaagacgcgcgcgagtgtttcctcgaagtgcgctccagcaaccagacagcctatcggctgtacgagcgctacggtttcaacgaagtgggccgccgccgcgattactatccggcgacaggcgggcgcgaagatgcgctggtgatggcctgcaccctggtcgattgatcgcactggcttatgtaggagcgagcttgctcgcgatggcgtcagcggtgacgccgcctgctgtcaggttttaggtgtgatgccggccctgctggcgctatcgccggcaagccggcttctagagggactcggatagcgcttcagcgtttgccatccagcggatcgcgctgggccagctcggcttcgtccaggccattgccgccgccgatatcgtcttcatcgacaatgctcaggtcccagtcggccggctggtcttcaccggcttcatgggcggagcgggcgccgtcttcgcggatcaggttttccggggtcagctcatcgtcgttgggctcatcctcggcgttgccggtcaggccggagccatggatgtgcctgtggggagtacgatgctccacagggctggaagcagggtcgccgaccctggcgccgggttcttcttcatcgaaatccagctcttccatggaacccatgcggtcttcgttgtcgtcgatgggctcgggctgaggcgcgccatagggacgtcgtgattcagtcatgacggttgctcatacttttgggcttaaagagtggacccaccagacctggcaagattcaaaggggtggataagcggtatctgcatagacgcgcgtgaccccgacagacagtcgtctgtcatagcaacgcatcaatcctgaggcttcatagcatgaacgaactacaagacctgattgataacaacgagcgttgggccgaagcgatcaagcaggaagatcctgaattcttctccaagctggcccgccagcagacgccggaatacctgtggatcggttgttcggacgcccgtgtaccggccaacgagatcgtcggcatgcttcccggggatctgttcgtacaccgcaacgtggccaacgtggtgctgcacaccgacctcaattgcctgtcggtgatccagtacgcggtggacgtgctcaaggtcaaacacatcctggtcaccggtcactatggctgtggcggcgtgcgcgcctcgatgcaggatcgccagctgggcctgatcgacggctggctgcgctcgattcgtgacctgtactacgaacatcgcgaagtcctggggcaactggccaccgaggaagagcgggtcgaccgcctctgcgagctgaacgtgatccagcaagtggccaacgtcggccacaccagcattgtgcaaaacgcctggcatcgcgggcagagcctgtcgatccacggttgcatctatggcatcaaggacggtcgctggaagagcctgaacgccaccatcagtggcttcgagcagctgccgccgcagtatcgcctgcgtccggtcggggcgctctgaggcgctgaaaacccatcgcgagcaagctcgctcctacgggcgatgtgccgttctgtagaagcgagcttgctcgcgatgggatgtaggcgttactgcttgtccgtcagatatgcggcggtgcttcggtgctcatcgacggtgccggcgccttcagctgcttcaactgggtctgcaccggcgtggtggcgcacttggcctgggcctgctccggcgtcagcttacggatcgaggtgtagaacagggcgcaggtctgctctttgttggtcacctgccagttctgcgtgcagcttttgagctgcactgtcgggttgctgcccggcttgctgcccatcccggcctgccagcaggccgcgctcagatcctgccccatcaccttcaaaccggccgcgtcggccttggcctcgtcgccgtcgtagttctccggatccgccgcgtaccagatgtaactcgggtggttggagcccagcaccggcaccttcaggcccgcgctcgggctgatctgcgccaggcccagcacattcacggtcgggccgtactgctgcttgatccagttacgcaccggcgcgccgaacgccaccattggcagggcggcgccgctggcactctggctgatctgtttgaccatggtggtctggtagtcctggaagtagccgtagacgccttccaggtccttgcccgcgctggagggggcagcgatcggtgcaatgtcgatgatggtctggtagcccggggtctgctcggcgggaatgccattggtggtgagcagggtggcccagcggtcggtggtggccgatttcaggtagtcctgggcctgagtcagcgagtagtccggcgggaagtgcagcaactcgacgctcttgcggttttccagggccatgcccaggggcaggaacaggtaccagctgtaggtccatttgccgtcgctgttgagcttgctggcgccctggtaggccaggtcgccggcatccagcagggcggtcagcggcttgccatagtccttcggaacaccgctgatgttggcgtacagctggttgttgtcggtcttcaccttgaccttggcggtgctgtagccatcgcgcttcacgctttgggtcaggtaatgctcgacggtctgttccagcgtccagttgcgaaagcagatcacgttgcagttgttggggtaggagaagagttgggtgacgcgctgggtgttgcccagcttcagatcgacgttggcctgggctgcggtgctcagggtcaggctacttagggtcaggccgcccagggtcagggcggcgagggggagggacaatcctgcgagtttcatgcttggctccttgtcagcgttggcctcgtctgtgcgaggtaagttccgtactgaaacagtagcgggtgacaaggaaaagggtggaataaatctttcttttgcacgcgcaaacggccgcttgggcggccgctgccgtcggttcaggccgggaagtgcagggcattgctcaggtcgcccatgggcgcctgcccccgggcggtcatcgccgtgtcccgttgcttgaggccgtcgagcggttccagctggaacacccgggtgatcagccgcaggatcgacgcggtgtcgtacaccgtatggtctaccgtgcccttgcgggcgaacggtgacaccaccagcgccgggatgcgtgtccccggcccccagcggtcgccctggggcggggcgacgtggtcccaccagccgccgttctcatcgaccgtgacgatcaccaccatgttctgccactgcgggctttcgcgcagcaccttcagggcacgcacgatatgccggtcgcccgcggccacatcggcataaccggcgtgcatgttgaggttgccctggggcttgtagaacgccaccggcggcaacttgccggcctcggcatcggcgaggaagcggttgctgctcgactcatcgcccaggcccgcatcgcgcaggtgatggttgcgttcgttgggatgctcgggaccgaactgcgcgaagtagttgaacggctggtggtggtactggaagttggggatcttcggaatccccgccgaatccttgtaggcgtccagcgtgacctgccaggcgccggcgtaccaggcccagtcgatgtccttgcgcgagagcttgtcgccgatggtgtcgtggcgctgcggcaccagcacattgggcaggtcggccttggcataggccgggcgctgcgggtcgcggatccaggtcggccagtagggcggggccatggtattgaccgcgtagccgtccggggtcagcaggctcgggccgaattgcggcgggccgctcatggcgctggccggggattgctccagcggcttgaggcgggtgtcgagcgggtcgtcgctctgcagggtggcgatctgcggcttggccaccgaattggccgcgtccggataaaacggcacggcggcgctgatcaggtactggtggttgagaaacgagccgccgaaggtgccctggaagaagttgtcgcacagcacgaactcccgggccacatcccacaggcgcaattcataccggctctgggcgtaatgacccatgggcaggccgccggagtcggcccaggcgacgaaaccatcgttcttgccgccgttgatctgcatctggttctggtagaacacgtgccacaggtcgcgggtgaccaggcccaggggcaggttttcgccatcggggcccttgagggcgaagggcgcattgggcaggcgttcctggtactgggtgccgaccgggtaggtcacgccatccagggcctggggcccgacctgggtgacgccaccccagaccggcggcaagaccgacaacaggctgccgtcgcggtcgcgttgctgatagtcggcgggcttgagggccgagagcggtttttccagccccgggaagtcggcgaacaggttgttgaagctgcggttctcggcatagatcaccaccacgttcttcacgttatcgcgcagcgcccggtccagctcggccggcgacagcgggcgttccaccggcttgcccggcgccgggtcgttgtggccgcaagcgctgagcgtcgcgccgacccccagcaccgccacgccgccgagaaaacgccggcggctggtgtcggtgggtggctccgtggcctgggaatgttctgggtctttcgagtgttcgtcgctcatgcgggtccctgattacctttcgatcaattcgtaacaaagtatttcggctgcacggtagcaaccgaatatgacggaaagactacagaaaaggctctgggacggggcttagacggtggtagggggaagctggaagacgtgtagggttgcttctgcaggagcggctggtcgaccgcaatgacggcatggcgggcaccctcggcctggcggccgatcgcgagcaagctcgctcctacaggggagcgagccgctggcaacagattacggcgccacgggcggcatgtagctcaaggtggtacccagtgcccacagcagcaccagcaccaggggggcgtggaccagcaactggacgaaggagaagccgatcaggtcccgcgccttgagccccagcacccccagcagcggcagcatgtagaaggggttgatcaggtttggcagtgcctcggcggcgttgtagatctgcaccgcccagcccaggtggtattgcaggtcattggccacctgcatcacgtagggcgcctcgatgatccacttgccgccgcctgacggaatgaagaagcccagtaccgccgagtagacccccatcagcagcgcgtaggtgtcgtgggaggcgatctgcacgaagaaggtcgagatgtggtgggccagggtctggccgtcgacgcccttgaccaccgtcagcaaggccgcgatggagccgtacagcgggaactggatcagcaccccggtggtggtcggcacggcgcgggccaccgcttcgaggaagctgcgcgggcgccagtgcagcagcgcgccgagcatcaggaacagaaagttataggtgttgagcccggaaatcgcggtgatcgccggcttggtggcgaactcatggtagagccagccggccgccagcagggccagcaggatggtcagcagcgggctgtattccagccactcgccggggcgggtacgcggttgtggcttgggcatgctgaagctcgggtcgataccgcaggccttggcgtcgcgcgccgagttcggaccgggggcggtggcataggcgatgaccagcgagacgacgatcaaggccagcagcaatacgccggactgccagagaaagatggtctgggtgaacggaatcaccccggtgatcgacaggatcgacggcggcaggctgccggggttggcctgcaattgcgcggccgaggacgacaggcccagggcccagaccgcgcccaggcccaggtaggccgcggcgccggcggcgcggtagtccatgcgcagttcggtacgccgggccagggcccgcaccagcaagccgccgaacaccagggacaggccccagttgagcaaggaagcgaccatggaaatcagcgccacccaggccacggcggagcggccgttcttcgggatgcgcgccagtttgtcgatcagcttcaccgccggcggcgagctggcgaccacataaccaccgatgaccacgaaggccatctgcatggtgaaggggatcaggctccagaaaccgtcgccgaaggccatggcggtgtcggtgggcttggcgcccatggccatggtggcgagggcgacgatgaccaccgccagcgcggcgaacacccaggagtcggggaaccagcgctcggcccagttcgagcagcgcagggcaaaacgggcggaacggctgtcttcaatgtctgtggacacgtcgatacctcaagtctttttatgattgtcaggaggtcggtcgcctcagtctggggcggccgaaaactgtgcaagaatgcggcaattggtaaccactgcaaaggattgaagtacatgccattcccgctcgaagaacgccaggcgctgctcaaggtcaagggtgtcggcgaaaccgtggtcgcccgcctcgaacaactgggcatcgattccctcgcccagctggcccgggccgatgccctggagatcgtcacccaggccgcggtcctggtcggttccagctgctggaaaaacagcccccaggcccgcgcggcgatccaggcggcaatcgccctggccaagggcgcctgaagcggtgagccgcgaaacgcctttcgcctatcaggcggtctaccgctacctggtggagtggctggacggtgccagcgcggccgagcagcgcctgccgtcattgcgcgccctggcccagcgcctcaaggtctcggtctccaccaccaagtacgcctatggcttgcttgaggatgaagggcggatctacgcccggcccaagcagggctacttcagccgccccgtgccggcgccagggctggcgccggatacggagctgctggacagggtctatgcctacgcccgccagcccggaatgctggcgctgtgcagcgacgccccggcgatgctgctgtcgctggacaatcccctgttgaccgccgagcgcgagctggtgcgccagtacccgcgctcccaggcgccgctgtaccagccgtttggcgaggcggagctgcgcacggcgctggccgagcgctacacccgctcgaccacggattactggcaggccgagcaggtatttctcggcacggatttgcgcgcggtgctggcgttgtcgctcgatgccctggagctgaacggcagcgtcgccctggtggagtcgccttgttcctgggcgatcctgcggcaattgcaggcggcgaagatccgcgtgatcgagctgccactggacgccgcaggacgcttcgatcgccagcgcctgcatgaggtgctgcaacgcgaaccggtgcgcctggcgctgctgtcttcgaccctgagcgcgccccacggcagcctgatgcccgcggcggacaaacggcagctgtgccgctggctgggggagcgcggcatctggctgttggaaaatgacagctatggcgagttctgcttcaccccggggccggcgcggtatcgcgattacgccgatcccgagcggctgctggtgttttccaccttcgacaaagtcataggttccgaggcgcccttcagctatgtgctgtgccgtggccagggcgcgcgcttgcagcggcattttctcgagcgcgcgttccgcctgtcaccgatccgccagaaggccgtggccaaactgctgggcagcggccgggtcgatcagcacctggttcagttgcgcggcctgctgcgcgaacgcatgggccagttgcaggcgctgctggccgaacacgccgccgagcagttgcgggtggtcaccccggccgggggcgcgaccctgtgggccgaggccacgcgcccggtggagatgctccaggtgtatgagcaattactggggcagggcatcgtcatcgccccggggcagatgttcagccagcaaggcctgtggcgccatcacctgcgcctgagtttcaccctcgactggcgccaggacattgccggcgccgtgcaacgcctggcccgggccatcgatcagacgccgtagcagtgtcgcgcctcggggaagcggccgtcgcgcacctcggcggcgaaccgctcgcaggcctggctgatcagcgcgccggcatcggcgtactgtttgacgaagcgcggcacctggggcccgcccaggcccagcaggtcctcggtcaccagcacctggccgtcgcaggcgggggaggcgccgatgccgatggtcggcatcgccgagaagtcgctgatgcgccgcgcgaggttttccgccaccccttccagcaacaggctgaacgcgccggcctcgaggtgggcgcgggcgtcggcctcgatggcctgggccgtggcgtcgttcaggccctgggccttgaagccgcccatgacattcacgtactggggcatcagaccgatatgcgccataaccggaatcccgcgctgcaccaggaactccacggtcggcgccagggccagcccgccttcgagcttgagcgcgtcacagccggtgcgcgccagcacctcggcgcaattgcggtaggcctgttgcggcgattcctgataactgccgaacggcatgtcggcgatcacgcaggccagccgggtgctggcgaccacggcgcgggtgtggccgatgatctcttccaggctcatgtccagggtcgaggtgcggccataaccgaccatggccgtggagtcgccgatcagcacgaaatcgacgaacgggtccatcagccgcgccatgtggctggtgtaggcggtcagggagacgatcttctgctggcctttcatggccaccagttgcggcacggtcaggcgtttgctgcgggtatggatgctcatggcggctttcctgttgcgggtgggaaagtcgccgattattggcgtccgcgacggcgattcaatgcacaggaaaagcctaaaaaccgacccagaagggggttgcggttgttcctcgcggcgtttgcgtagaccatgggcgccttgaattctgcccaacaccgagtggctttatgtccttttcccctgacgcgcggccggcgccgttttcccggtccgactacaagaccctgggcctggcggcactgggcggcgccctggaaatctacgatttcatcatcttcgtatttttcgccctgaccctgagccagctgttcttcccgccggaaatgcccgagtggctgcggttgttgcagagcttcgggatcttcgtcaccggctacctggcgcggccgctgggcggcattctcatggcgcacttcgccgaccgcctggggcgcaagaaggtgttcagcctgagcatcctgatgatggccctgccgtgcctgctgatcggcatcatgccgacctacgcgcagatcggttatttcgcgccgctgttgctgctggcgctgcgggtgctgcaaggcgcggcggtgggcggtgaagtgccgagcgcctgggtgttcgtcgccgagcacgcaccggccggccaccgcggttacgccctgggctttctgcaggccgggctgaccttcggctacctgatcggcgcgctgaccgcgaccctgctggcgcaactcttcacccctgcggaaatcctcgatcacgcctggcgttatcccttcctgctcggtggagtgttcggcgtgatcggcgtctggctgcgccgctggctcagcgaaaccccagtgttcatggccatgcaggaacagcgcgacagcgccgtcgaactgccgttgcgcaccgtgctgcgcgagcatcgcctggccctgttgccggcggcgattctcacctgcgtgttgacctcggcggtggtggtgttcgtggtcatcaccccgaccatgatgcagaaaaccttcggtatgagcgccagccacaccttcgccctgagcagcctgggcatcgtgttcctgaatatcggttgcgtgctggccgggctgattgtcgaccgcatcggcgcctggcgcacggtgatgctctacagcctgctgctgccgctgggcatcggcctgctctacggttgcctgatcagcggcggcgcctgggtcggcctggcctacgccatcgccggccttggctgtggcgtggtgggcgcggtgccatcggtgatggtcggcttgttcccggcgcggattcgcgtctccggcatttcctttacctacaacatcgcctacgcgctgtgggcgagcaccacgcctttgctgctgatcggcctgatgccctggagcccgtggatctgcgtgatctattgcgcggtgatgggcgcggtcggggtggtcagcgcggggtactttggtacgcgcatgccgaggctggcaggcagtggggcgcctggggtctgtgccgggtcctgaagacgctttcgcgcaggggaaaatcgcccccgcaaacgcctgcaggcgccggggaacgcgggctagagccttcgccgccagcccacgttttagcccggccaagaccgctgaaagttgtgcttagccaaggcccatttacccgctaatctctcgaaaaaaacgcgcggtccacgcgccagttttcgggagctgccttgatccggtccgcccttcgttccctgcgtgatttctccacgctgcccccgctgctgcaggcggcgtggttgtcctttgccattggcctgttcatggccctgctgcatctgtggatcttcaaccttgtcgactatgggctggacggtgccaacgtcgaatccctcagcggcaaggtgctgtatgccgaccgtggcgggatactgatagaggacgcggagagtggcgaatgcacccggctcaaggtggttcgtggcatcagctatctgaacgtcggccatgaccagatcctggggcgcacgctgagcttcacccacctgcgcgacgcggtgctgacctgcaccctcgatggccaggagctgtgcatcgcgcaatgcgccaacgccatggaatgcctggacagccgccgcgagcgcgagacgccgcatggcatgttgatcgtcgcgttcggcaccagcctggtgtgcctgggcctgcatgggctgcgccggcgcaagcccgcgtcgggtagcgggatcttttgaattgccgccgggcaccgttgcccctaggctgtgcggcatccgtttcagaccaggagccccgcatgcaggtcgtgccgatactcgagacttgtgcacaggtgcaggcgcgcgtgcgcgagctgcgcaaccagccggatgtgcgcaagtacatgtacacctcccacgagatttccgaggccgagcaccgtgcctggctcgactcgctggcgggcaatccgcggcagtcggtgttcgtggtgctgcaagagggaatcgcctgtggcgtggtgtcgctgaacgcgatcaatgccctgcacaagagcgccgactgggcgttctatctggacagcggcttgcagggcaagggcctgggcagccagctggaattctggctgctcgaccatgccttcggcgcggccggccttgcgaagctcaactgcgaggtgctggcgctgaaccaggcggtgatccgcctgcaccagaaattcggtttcaccctcgagggcgtgcgccggcagaacgtcgagaaggacggccagcgcatcgacgtggtgctgctcggcatcacccgcgaggaatgggccgcccggcgcccggatatgctcgcggtgatggcgcggctggggcgctgaaagccgtcatccataaccgccagatggcaagcgtatgaccattgcgtcattttgccggggccggctgtccgggccggctatcatcagccacgacgatttccacaggtgggggctttcatgggcgcagggcacagtcacggacaggttcgggccggacacgaacgcaagttatggatggccctggggctgacgggcagtttcatgatcgccgaggtgatcggcgcctttgtcaccggcagcctggcgctgctgtccgatgccgcccatatgatgactgacgcgctggcgctggcgatctccctggtggcgatccaggtcggcaagcgcgcagccgatcgcaagcgcaccttcggttatgcgcgcttcgagattctcgccgcggcgttcaacgccctcctgttgttcgtggtcgccttctacatcctgttcgaggcctggcagcgcctgtccgcgccggcggaaatccagtccacgggcatgctggtgatcgcggtgctggggctggtcgtcaacctgatctccatgcgcctgctggcctcggcgagcgccgaaagcctcaacgtcaagggcgcctacctggaggtgtggagcgacatgctcggctccatcggcgtgatcgtcgcggccttggtgatcatgtacaccggctggggctgggtcgattcgctggtggccgcggccatcggtttctgggtgctgccgcgcacctggacattgctcagggagagcatgaacgtgttgctgcaaggcgtgccggacggcatcgatatcgaccaggtcgagcagagcatccgcgccatcgacggggtgaccgaggtacacgacttgcacctgtgggccctgaccagcggcaagaacgtgatgagcacgcatctggtggccgacctggggcggcgcagcgagcagcagatcctcgccgaagtcaccgagttgatgcacgagcgcttcgatatctcccatgtgacggtccaggtcgagcaggccggctttcacgaacaggggcacgaagagcacgtacattaatcacctgtagccgctgcatcttgcggctacatccgaacctgtagccgctgccgagcctgcgaggctgcgaccgaccgcgcagcgggcgctgctcttgaactcgcaggaggtcctgcgaccagcgtggcccggaccatcgcagcctgcggcagcggctacaccgatcgcatgtaccgaactatcgggttgcaccctgtagccgctgccgagcctgcgaggctgcgatcgaccgcgcagcgggcgctgctcttgaattcgcaggaggtccttcggacctatcgcagcctgcggcagcggctacaccgatcgcgtgtaccgaactatcggattgcaccctgtagccgctgccgagcaccgcgaggctgcgaccgaccgcgcagcgggcgctgctcttgaactcgcaggaggtccttcggacctatcgcagcctgcggcagcggctacaccgatcgcatgtaccgaactatcgggttgcaccctgtagccgctgccgagcctgcgaggctgcgatcgaccgcgcagcgggcgctgctcttgaactcgcaggaggtcctgcggacctatcgcagcctgcggcagcggctacaccgatcgcatgtaccgaactatcgggttgcaccctgtagccgctgccgagcctgcgaggctgcgatcgaccgcgcagcgggcgtcgctcttgaactcgcaggaggtccttcggacctatcgcagcctgcggcagcggctacaccgatcgtgtgtaccgaactatcgggttgcatcctgtagccgctgccgagcctgcgaggctgcgatcgaccgcgaagcgggcgctgctcttgaactcgccggaggtccttcggacctatcgcagcctgcggcagcggctacatccgcatcttgcggttacccccgcgctgtcagtcgcgctcttcgagcacgtagccgacgccgcgcagggtgtggatcagcttgctctcgaacgggtcgtcgatcttggcccgcaggcggcggatcgagacttccaccacattggtgtcgcaatcgaagttcatgtcccacacgaacgagatgatctgggtccgcgacagcaccacgccgctctggcgcatcagcaggtgcagcagggcgaactccttggtggtcaggtcgatgcgctgtttgccgcgaaacgcccggtggcggccctggtccagctccaggtcggccacccgcagcacgtcgggggtcggcgactgctcgctgcgtcgcaacaggctgcgcacccgcgccagcaactcggggaattcgaacggcttgaccaggtaatcgtcggcgcccaggtccaggcccttgatccggtccaccagccgcccctgggcggtgagcatcatgatccgcgtattgctgttctggcgaatgcgctgcagcaccccccaaccgtccagctccggcagattgacgtcgagaatcaccaggtcgtaggcgtgctggcgggtcaggtgcaggccgtcggcgccgttattggcgcaatcgacgacgtagccgctttcgctcaatccctgatgcaagtagtcggcggttttcggttcatcctcgatcaccagaatgcgcatgctgaattagcctcggtgtttaatgcagtggggcagtcccataacttcgttggaagtaacgggctggatgattcaactttcaaagtttttatttaaaactttcgaagtggcgtgcggggagaagttgtttctctatatttcaagttgttggttattgcacttgccttcgggtcgatggcccggatgttaatacacaagcccgtggcagagcgtttgctaacggatttgtaatctttgcgccaccctgtcgataagtaccgaaggctacatttggccggcactaaatactcacctgttagttgttttatgggtggagtgtggatgcgtcgtgccggttcaatttcctcgcaccgcagagcctccgccgtcactctgtaccggtaaggggccagaacgcgttatgccaaccctcattaaaaaacttgcctggatagtcggggcattgtccggcgtcctgttgttggccagtgccgcgctgcaggacgccgcggcggccgagagccgggtgctgaacctcgacaacgccttggccagtgcctttgccaacaaccccgaactggcggcggcgcgctgggaaatcgacatcgcccagggtggtcgccagcaggccgggttgatccccaacccggtgttgtcctgggacgccgaagacacccgccgcagctcgcgcaccaccaccgtcaagctcagccagactctggaactgggcggcaagcgcggcgcgcgcatcgatgtcgccagccgtgcccaggacgccgcggcgctggagctggaacgccagcgcaaccagctgcgcgccgatgtgatcgccgccttctacggcgccttgcgtgcccaggagcgcagcgatctggccggccgctccctggccctggccgagcgcgggctgacggtggccaagggccgagtgagcgccggcaaggcctcgcccgtggaggccacccgcgctcaggtccagctctcggaagtgcgcctggagctgagccgcgccgagatggaccgggccaacgcctatcgccagttggcgagcgtgaccggcgccgccaccaccgacttcagcgccgtcgcggagccggccagcgggctgccgtcgctgccgccttcggcacaattgctggcgcgcctgcaacagaccaccgaactgcgtctggcccaaatgcaggtggtgcagcgcgaagcctccctggggctggaaaaggcccagcgcattcccgacctcgatatcagcgtgggcagccagtacgacgccagcgtgcgtgagcgggtcaacctggtcggggtgtcgatgccgattccgctgttcaaccgcaaccagggcaacgtcctgtcggccgcgcgccgcgccgatcaggcccgggatctgcgcaacgccgcggagctgcgcttgcgcagcgaaaccaagctggcgctcgatcagtggagcaccgccagcaacgaagtgcagtcgttcaaccaggtaatcctgccggccgcgcaaaacgccgtggacaccgcgacccgtggcttcgagatgggcaagttcaacttcatcgaggtgctcgacgcccagcgcacgctgatcagcgcccgcacccagtacatcgccgccgtggcccagtccaccgacgcctgggtgcgcatcgagcgcatctacggcgatctcgccggccccgatcgcacgctgtgagaacagcgttgttcgtcctgttgggcctgggcgcgctgctggtcaccgattgcagcgtgccgctgccgagccgggtcgaggagagcccatcccattggtgcctgcatgagttgcatcgggcgcttggcgatttcttttttccacagacctcatgacgcgtcgctgttgccggttggcgcgttgagtcgatttttttcaggagcatgcatggacaagaaacgaagcacagccttggcgttggccgtggcggtcgcgctcggcgtggccgggttgatgtggcaggagctgttccaggcggcgccggtggccgcgcaggcgaaacccgcggccaaggcggacacgcacaaggacggcgaggcgcatcaggaaggcgaagaggggcaagcggaaggtgaggcccatgccgaggaagagggcaaggtcgaactcagcgccgagcagatcaaggccgccgacatccagctggccgaggccgcgccacgggatctcagcagcttgctgacgctgccgggggagatccgcttcgacgaggaccgcacctcgcacatcgtgccgcgcgcggccggggtggtggagtcggtggcggtcaatctcggccagacggtgaagaagggcgagctgctggcggtgatcgccagccagcagatctccgaccagcgcagcgaactggccgccgccgagcgccgggtcgagctggcgcgcaccaccttccagcgcgagcgccagttgtgggtcgaccagatctccgccgagcaggattacctgctggcgcgccagaccctgcaggaagccgaaatcgccctgaacaacgcccggcaaaagatgaatgccctgagtggcagcgcggtgctggcgggcggcaaccgctatgagatgcgtgcaccgttcgacggcgtggtggtggaaaaacacctgagcgtcggcgaggtggtgggcgagaccagcgccgccttcaccctgtccgacctgtcccgggtctgggtcaccttcggcgtgtttcccaaggacttgaacaaggtccgggtcggcaagccggtccgggtgcaatccacagaactgggcacccaggtgcagggcacggtggcctatgtcggcagcctgctgggcgagcagacccggaccgccacggtgcgggtcacggtgcccaacccggacgatgtctggcggccggggctgttcgtctcggtgcaggtggcgaccgacacctaccaggccggggtgaccgtgccgcagagcgcgatccagaccgtggaagacaagccttcggtgttcgtgcgcgtcgccgacggtttccaggccacccccgtggtgctgggcggcagcgaaggcggcttcgtcgagatccgcgaaggcttgcgcgccggggcccaggtggcgaccaccggcagcttcatcctcaagtccgaactgggcaagggctcggccgagcacggccattgatccgcactgagtgtttccctggagagtgacttcccatgtttgaacgcatcattcaattcgccatcgagcagcgcatcatcgtgctgctggcggtgctgctgatggccgccgtgggcatcggcagctaccagaaactgccgatcgacgcggtgccggacatcaccaacgtccaggtccaggtcaacgccagcatgcccggctactcgccgctggaaaccgagcagcgcatcacctaccccgtggaagtggccatggccggcctgcctggcctggagcagacccgttcgacttcgcgctcgggcctgtcccaggtgacggtgatcttcaaggaaggcaccgacctgtacttcgcccggcaactggtcaacgagcgcctgcaggtggcccgcgaacagctgcccgaaggcgtggaggcgagtatggggccgatctccaccggcctcggcgagatcttcttctggacggtggaagccgagcccggcgcgctcaaggaagacggcacggcctatacgccgaccgatctgcgggtgatccaggactgggtcatcgccccgcaactgcgcaacgtgccgggggtggccgagatcaataccatcggcggcttcgccaagctctatcagatcgccccggaccccaggcgcctggcggcctacaacctgaccctcagcgacctgatgaccgccctggagcgcaacaacgccaacgtcggcgccggctacatcgagcgcaacggccagcagttgctgatccgcgcgccggggcaggtgaagtccatcgaggacatcgccaacatcgtgatcaacaccgtggacggcacgccgatccgcgtcagcaacgtggccaccgtggacatcggtcgtgagctgcgcaccggcgcggccaccgagaacggccgcgaagtggtgctcggcacggtgttcatgctggtgggggaaaacagccgcacggtgtcccgggtggtggcggaaaaactcgccgagatcaatcgctcgctgcccaagggggtgacggcggtcacggtgtacgaccgcaccaacctggtggacaaggccgtggccacggtgaagaaaaacctcatcgaaggcgcgctgctggtcatcgccattctgttcctgttcctgggcaatatccgcgcggcgctgatcaccgccatggtgatcccactggccatgctgttcaccttcaccggcatgttcaccaacaaggtcagcgccaacctgatgagcctcggcgcgctggacttcggcatcatcgtcgacggcgcggtggtcatcgtcgagaacgccatccgccgcctggcccatgcccagcagcatcacgggcgcatgctcactcgctccgagcgcctgcacgaagtcttcgccgcggccagggaagcgcgccgggcgctgatctacgggcaactgatcatcatggtggtgtacctgccgatctttgccctgtccggggtggccgggaagatgttccacccgatggccttcaccgtggtgatagctcttctgggggcgatgatcctctcggtgacgttcgtcccggcggcgatcgcgctgttcgtcaccggcaaggtcaaggaggaagaaaacttcgtcatgcgcggcgcccgccgcggttacgaaccggtgctgcgctgggtgatgagccaccgctccctggcctttgccctggccgttctcagcgtgctgctctcgggcctggtggccagccgcatgggcagtgaattcatccccagcctcagcgaaggcgacttcgcccagcaggcgatgcgcgtgcccgacgccagcctcactcagtcggtggagatgcagaagaccctggagaaaaccctgctggcgcagatcccggaaatcgagcgggtgttcgcccgtaccggcaccgccgagatcgcttcggacgtgatgccgccgaacatttccgatgcctacctgatgctcaagcccaaggcgcaatggccggacccgggcaagtcgcgcgaggcgatcattgccgacatcgaacgggtcagcaacagcctgccgggcaacgtctacgagctgtcgcaaccgatccagctgcgcttcaacgagttgatttccggggtgcgcagcgatgtcgcggtgaaggtcttcggcgatgacatggcggtgctgaacaagaccgccgaagagatttcgcagaccttgcagaagatcgacggcgccgccgaagtgaaggtgcagcagaccaccggcctgccggtgctgacggtgaatgtcgaccgcgacaaggccgcgcgtttcggcctcaacatcggcgatgtgcaggacgccgtggcgattgccgtgggcgggcgcaaggcgggcattttgtatgagggcgaccggcgcttcgacatgctggtgcgcatgtccgatgcccagcgcaccgatatcgacgggctgtcgcgcctgctgattccggtggcggcggccgcgggcagcgtcaacgggcaactgggtttcatcgccctctcggaagtcgccagcgtcgacctggtgctcggcccggcgcaggtcagccgcgagaacggcaagcgcctggtgatcgtcagcgccaacgtgcgtgggcgcgacatgggttccttcgtcgaagaggcgacccgggccattggcgatcaggtgaagatttcgaccggctactggatcacctggggcggccagttcgaacagttgcaggaagcctccaagcgcctggaaatcgtggtgccggtggcgctgctgctggtgttcggcctgctgttcatgatgttcaacaacctcaaggacgggttgctggtgttcaccgggattcccttcgccctgaccggcgggatcatggccctgtggctgcgcgacatcccgctgtcgatctcggcgggggtgggcttcatcgcgctgtcgggggtggcggtgctcaacggcctggtgatgatcgcctttatccgcaacctgcgcgaagacgggcggatgctcgccgcggcggtcaacgaaggcgcgctgacccgcctgcgcccggtgctgatgaccgcgctggtggcgtcgctggggttcatccccatggccctggccaccggcaccggcgccgaagtgcaacggccgctggccaccgtggtcatcggcggcatcatctcctccaccgccctgaccctgctggtgctgccggcgctgtaccactgggcgcaccgcaaggaagaagaacaggaactgcaggacctgctaaacgactgacccgcgaccggtgtcagccaaccccgcctgcgtcatacgcaggcggggttttgtttattgagagggcacgcaccctgtagccgctgccgcaggctgcgaaaggtccgcaggacctcctgcgatttcaagagctgcgcccgcttcgcggtcgatcgcagcctcgcaggctcggcagcggctacagaggggggcgtgggggcaaaaaaaagcgccccatgcgggacgctaaaaattcatctctttccaaaggagcattcgaaaaaacgcttcagagatgaatgtgctcggggtgggccggcgtcagcgggaggctgtgcatgcctggggccctgtggttctgtgaggggcggcgccgattgcgccgttgtggttgttttcgccgttgtgctgttgctggccgagccagaattgttccagggcatgcctggcgcgttcgctgctgttatcgctgggaagcgcgctgggctggccaggcggagtcaggtgggcaggcttcaagacatgatctcccgcaagtggctggccgccagcgaagcgctgtcggctcgggcatgcgggcaagtatacgaaggccaacctgacgagaaggtgagggcgatattacagttctgaaagacaggcgtctgtgaagaagttttaacgtcgggcgggcctctcacccgcccggcgcaagggctcagagaatggccagcgggtattcgacgatcaggcggaattcctccaggtcggattcgaagctgctggagcgcacggtggcctggcggatgcgcagcgacaggtccttgagggtgccgccctgcactacgtacttggcttcgatatcgcgttcccagcggcgctggtcggtcagcggattgccgtccgcgtcgcggcgcatgtacaccgcgttggcattgctgtagtcggcgtcgctgcctttgccatagcgggtcatgaacgacaggccggggatacccaggggttgcatgtcgaggtcgtagcggaccatccacgagcgttccttcggcgagttgaagtcgctgtactggatcgagttgtcgaggaagatcgagtccgactggcgcaggtagtcgaagtcgtcgtcgccgttgttgcgctggtgcgacagggacagggtgtgggcgccataggtggcgccgaccttggcgctccagatgtcgttgtcgaacttgccgagcagtttcttgccctcgtccaccgccttgtaatagttgaacccggcgaacagcgagaactggtcggagatcggccaggtcgccgcggtgccgaagtaatactggtcccaggcgtccttcaggcggctgctgtagaggctgaaactgaggtgcttgttcaggctgtagtcgccgccaaagtaggcgacccagggcgagtcgaccttgccggcatagaaggtggcgaaaccgtcgcgcaggctactgctgtcgggctggctcatgctgtgcaggcgcccgccctggaggctcaggccgtcgatgctggtgttctcgaaggtggcgccgcgaaagctttccggcagcaggcgcgagtcgccgtaatgcaccaccggggttttcgggaagacgtcgccgaccttgatcacggtgtcaagcaggcgcattttcgccgcgccgccgaccttgctgtagttgtcggccggctggttgtcgctgtccaccggcagcatgccgaacgacccgcgaccgccactgcggccggcgcccgagtcgagcttgaggccatacatggcaaaggcgtcgaggccgaaaccgacggtgccctgggtaaagccggattcgaacttgccgatcagcccctgggcccaggcctgcgaataaccgttgccggtggggctggactggcccttgcgatcgtcgcgattgaagtagtagttgcgggccagcacgttgaggctgctgccttcgataaagccttcgggctggtcgtctgccgcgttcacggccaacgggctgagccccagtaccgcacaaaacacggacagggaccagcgggtttgagtgcgcatgttgtttgctcctggatatgggcagctatcagctgttaggtcgcctgtggcgttcttgttagttgtactcgcgaaccgcctggttaacggctggagtcagcgtcgatagttgcaaacaacagataacgcggaggtgacccggttattacaattctgcaaggctggaagttgtaagttgtttatggttaaagccaagttccttgttttatatggggtttgttcgagggcgggaaatgccctggtgtttattacatataagtaatgtgcgcgtgatcttcccgacagggtccgctggttatcctcgttgcaactaaccagaacgaggaaacagtcatgaagttatttaaattgagtatcgccgtcctggtactttccttgtcatccctggccatggccgaaggcggcggcgaccgcaccttcgaccgcgccatgcaggcgaacgagcgggccatggcggcctacgcggcgaaacagggcaaggaggcgccggtggtggaaaactatcgctacggcatgcccctggacatcaagaaggtggtcagcgtgacgccgccggccaagggctgcaacccggtgccgtcacgcatgacctatgaggattcggccggacagctcaagaccctggagtatcaggtcatgggccagtgccgcaccaatggcagttaatcctcaacgtcttcatggggcgcgggaagcggttcgagggccacgatcatgtcgatttccaccgcggcattcttcggcagctgatagaccccgagggacgtgcgggtgtgcaccccggcctcggcaaagatcgaatagagcacttcggaggcggcgtcggcgacttcgctctgctgggtgaagtcggcggcgctttgcacatagacgttgagccgcaggacttttttcacccgctgcagatcgcccagcaactgggcgaggatcgccagggcacgcatggtgcaaatacgtgcggcataccggccgtcttccagcgaaacatcgccaccgacccgcccgaccactttcacggtgttgtcgatgcgtgggatctgcccgctgacgtacacctcgtcgccgttctgcaccgcgggcacgtagttgccgccgatgcgcatttcaccgtcgaaagcgtgtcccagacgcgtcgccacctggtcgaacagggccttgcgtgaagcctccatagattgcactccgtcgattgccgttgattttccagagcacgactatagcccttcttccgggctccggagcatggctcgtagccccgcagggccggggcctgaggcgcttcaaagttttttggtcggatatgtcttatgggctcttcagaaaaatactcaagcgccgatggctagagacaatgctgcccactattactgcccatcggtgcatcccatgttcaacaaaagcttgaagcaagagctgttggctctacgcgaagaactctcgagcctccagcaagtgaaggacagtctcgacagcgaaatgctggtgctgattctcgatcccgatggacgcattttgtcggccaacgacaacttcaaccaggaaatgctctacaggggcagcgaactggtcggtcgtcacatcgaggacatcgtgccggcctacgtcaagaccgatgaattccaccaccgtttcaaggcgacgctgacccgtggcgagcattttgccggcgcggtacgcctgctgcgcggtaatggccaggaagcctggctgcgctcgatttcccagccggttcgcgattcccaggggcggatcaaacagttctcgatctactccagcgacctgacccgcaccatcgaagcctctcgcgagcacgagaacctgatcggcgcgctggtccgctccacggcggtgatcgagttcgacctcaacggcaacgtgctgacggccaacgagcgcttcctcaccgccatgggctacagcctggcgcaaatccagggcaagcatcaccgtaccttttgcgagcccgaggaatacaacagcgccgagtaccaggcgttctggaagcgcctgaacgccggcgagttcgtcgccgggcggttcaagcgcattgacagctacggccgcgtggtctggctcgaggcttcctacaacccggtggtcgatgccaacaaccggctgtacaaggtggtgaagttcgccaccgtgatcaccgaccaggtgaaccaggagcaggcagtcgccgaggcggcgaacatcgcctacagcacctccttgcaaaccgacaacagcgcccagcgcggcaccaccgtggtgaccgaggcggtgaacgtgatgcgcgacctggccaagcacatgcagcaggccggcgaaggcatcgaggcgctgaacgagcagtcgctggtgatcggcaccatcgtcaagaccatcagcggcatcgccgagcagaccaatctgctggcgctcaacgcggcgatcgaagcggcgcgggccggtgaacagggacgcggctttgccgtggtggccgacgaagtccggcaactggcctcgcgcaccagcaaggccaccgacgaaatcgtcggcgtggtgcggcagaaccaggacatggcgcgcgaggccgtggcgctgatgaccgatggcaaggcccaggccgagcagggcctggccctggccgccgaagccggcacggtgatcgtcgagatccaggacggcgcgcagaaggtggtgaacgccgtcggccagttcgccagccaattgtccaactgagccctgtcccggacccggcatcaggccttttccaggccatgacgtcgggtgccgagtggtcgccaggtcgacggccacgatctgctccaacgccagcgcgccctgcgcgggtggttaggaagtttcctatctctatggaagataaatcctaaagagccttgagcgcgtcaagaacgcgttcccaacgccgatggtgaggctgctgcagtctccaatcacaggctatcggtgtatccatgttcaataaacgtttgaatcagaagctcctcgcattgggtgaggagtttcgtgcgctcgagcaggtcaaggaaggtttcgagcgcaccctgctcagtgtccatctcgatccgcagcgccggatcctggtggcgaaccgcaacttcacccagtgcctgcagtattcccccgaagcgctattgggctggcccatcgacaatctgctgccggacgatgcccggcccgaagaggcgcactcgcgtttcatgatggcgctggcacgcagcgagcctttcgacgacaccctgcgcctgcgtcgtggcgacggtcatgacgcctggctgagggtgatcctgcagccgatcttcagcaccgagcggcaactcaggtccttttccctgatcgccaatgacctgaccgaaaccgtggagactgcctgcgagcacgacaacctgatcgcggccctgctgcgttcgaccgcggtgatcgagttcgacctcaagggccgggtactgaccgccaacgagcggttcctgagctgcatgggctacagcctcgagcagatcctgggccagaaccacagcctgttctgcgagccgcaggagtacaacagtccggcctacaaggtgttctgggagcggctgaatgccggcgagtacgtcgccgaccgcttcaagcgcatcgacagtctcggccgcgtggtttggctcgatgcctcgtacaacccggtggtcgatgccaacggcaagctctacaaagtggtgaaattcgccacggtgatcactgagcaggtcaagcaggagcagtccgtcgccgacgccgcggagatcgcctacaccatctcgcagcagaccgacagcagcgcccagcgcggctcttcggtggtgaccgaggcggtgcaggtgatgcgcgacctggcgacccacatgcagcaggccagcgacagcatcgaggcgctgaacgagcagtcgcgggtgatcggcagcatcgtcaagaccatcagcgacattgccgagcagaccaacctgctggcgctcaacgcggccatcgaagcggcccgcgcgggtgaccaggggcgcggcttcgcggtggtggcggacgaggtccggcaactggcctcgcgcaccagcaaggccaccgacgagatcgttggcgtggtccggcgcaaccaggacatggcccgcgacgcggtggtgctgatggccgacggcaagacccaggccgagcagggcctgggcctggccgccgaagccggcacggtgatcgtcgagatccaggacggcgcgcagaaggtggtgagcgccgtcggccagttcgcccatcagttgtccggctgatgggttggcatggagggggccgctgtcagtcctgccggtggttttccagatggggcgcgatcagggtttcgaaccattcgataaaggcgttcagccggcgcgagcgatggttgcgattgggatagagcgcggagatcgccatggacgcggggcgaaaaccgggcaggacttccaccagttcgccccgctcgagcaggtactgcacgtcgaagcgcgggatctggatcaggcccagcccggcccggcagcaggcgatgtagttttcggcgttgttgacgatcacccggctgggcaaattcagttccagctcgtgaccttcggccaggtattcccagggctgttcgcggcccgtgctgggggagccgtagccgaccatccagtgaccgtcggccaggtcgcccggcgtttgtggctggccgtgccgggccagataggtggggctggcgcaattgatcagggccaggtggcccaggcgccggacgatcaggctgctgtcgcgcagggcgccgacgcggatcgcgcaatccacgccttcctgcaccaggtcgatggaacggtcggtggaacccagcgcgagcttcaggctggggtagcgggcgaaaagctcgggcagggcgggggcgatgaggcgccgggcaatgcggctgggcacgtcgacattgagccggccacagacgtccagttgacgggtgtgaaacagctgctcgagttccaccgcatcgctcagcaacaggcgcgcgcgctccagcaggaccgcgccgtcggcggtcagctgaacctggcgcgtggtgcggtgcaacaggcgcgtggcgagggcggtttccagttgctgcaccgccgccgagacggtagcccggggcagttcaagggcgtgcgcggccttgatgaaactgcccatgtcagccacctggatgaatacacggtactgctcgagcttatccatggatggggcattgttccggagcttgtgggtggtgcgctgggtactgttgtaggtgcgagcaagctcgctcctacgggatcatgtcgcacctgatggcgatcttttgcaaacgccaatctacctcgccccttggcggattactcgggtcgatgacaaccgtcgatcagaaggacgggcctcacttggtggtgtagccaccgttgatcagcagggtctggccggtgatccaccagccgtcggtgaccagatgacggatgaagggcaccacgtccttgatgtcggtcaggccggtcttgctgaagccggacagcgccgcggcggtcttgtggtaagccacggcgtccgcgccctcggccgggtagaagaatggcgtgtccatcggcccaggacctacggcggtcaccgagataccgcgggcaccgaactccttggaggcggcgcgggtaaagtgttccaccggagccttggccccgccgtaggcggcatagaagggcgtgtaggcgccgagcagcgaggtcaccagcgacaccagcttgccgtggtcctccaggtgcttgccggcttccttgataaagaagaacgcgctcttggagttgaccgcgaacatgtcgtcgtactcggcttcgctgatctcgactatgggttttttcaggaccttgcccacggtgttgatggcgatgtcgatcttgccgaaacgcgccttggcgtcgctgaagagttgctccacggccgcggcggcggtcaggtcggcctgccaggcgtgggcatcgacgcccaggttcttgatcgccgccacggtccggtcggcgtcggccttgctggcggcgctgttgtaatgcacggcgatggccttcacgccatgggctgccaggtcccgggcgatcaggccgcccaggttcttcgcgccaccggcgatcaacgccactttattgttcaaggaatggtctgccatggaaaagctccttcagcctgtgaggtgaaggcccagtctaagcagccgcgagtcagggataagcccggtcaatctggatggattgtccagggaaattgcccaatcccgactgctgtgccggaccgggatgccgctacaatcggcgtttttctcctggagccttacccatgagcccatcccatcgtcgtccggttccgctggccaaggcctaccgcctgctcaaccacgggccgaccgtgctggtcagcgccacccatggcggccagcgcaacatcatggccgcggcctgggccatgccgctggatttcgagccgccgaaagtcgccgtggtgctcgacaaatccacctggacccggcaactgctggaagcctccggcaccttcgtgctcaacgtgccgtgcgccgcccaggtcgatatcgcgcagaccgtgggttccacttccggcctggaactgaaccgcgaccagggccgcgacaagttcgagcgctatggcctggcgaccttcgccggcgagctgatcgacgcgccgctgctcgagggctgcgtggcctggctcgaatgccggctgctgccggaaccgcacaaccatgaacgctacgacctgttcctcgccgaagtcatcgccgcccaggccgatgagcgagtgttcagcgacggccgctggcatttcaccgggcacgatgccttgcgcaccttgcaccatgtggcgggcgggcatttcctgacgattggcgatgcgctggacggcaagaccctggcgtcgtgaacggcaatacaccgccgaactctcctgtagccgctgccgagcccgcgaggctgcgatcgatcgcgtagcggtcgccaaaccaggcgccgcattcatccagctaaaccgcgtgcgcaggtttggcgaggactgcgtcctcgaacgcagcctcgcgggctcggcagcggctacaggtgggcttaccagctgacggtgctcagggcgtcggcgaagaccttgagtttgggcgagtactggcgcgacggcgggtagaccagcgacagtgcccggctacgcccggaaaaggcctgcaggatcggcaccaggcggccgtcggcgagggcgtcctcgacggcgaagttcatcaactgggcgatgccgaagcctcccagcacaccgtccaccagcgcgtcgccgatatcgaagatcagccggctgggcacgctgacatcgcgcaccttgccgtcgcgcatgaattgccagtccaccaggcgcccgctgcgcaggttacgcacggtcaggcagttgtgctgttgtagctcttccactgtctgcggcgtgccatggcgcgccaggtaggccggggatgctaccgtgacccaacgcagcggcgccagcggccgggcgatcaggcgctggtcctggatctcgccggtgcgcaggatggcgtcgaagccttcgtcgacgatgtccaccaggcgatcggtcatcaccgcctcgatgctcaggtccgggtattgctcggtcaggcgtccgatcagcggcatcaccaccttgcgtccgaacagcgacggcgtgctgattttcagcagcccggtgggtgagtcgcgacggtccagcagcaggctttcggtctgcgccagttcggccagcagcggcgcggcgcgctccaccagcagttggccgtccggggtcaggctgacgctgcgggtgttgcgttgtagcaggcgcacgcccagttgttgctccaggcgcgaaatggcccgcgacaggccggactgggtcagccgcagatcgccggcggcgcgggtaaagctgcgggtctcggcgacccggaccagcaaacgaacggcattcagatccatgattaaagtcatcactgaaagagcaatgacggtatttatcatctaatcggcatcaaagaaactgagggtccttgattcattcccctttattttccacacaaggactcgacgtgatgcccgccacctcttcagccaggccgtcaggctggatgctgctcctgctggccagtgcgcagctgatcatcgccctggacgcgaccatcgtcttcgtcgccttgccggagatcggcagccacctgggtttttccgcgcaacagctgcaatgggtggtcagtgcctacagcgtggccttcggcggcttcctgctgctgggcggtcgggcggccgacctgctgggcaagcggcgtttctatatcgtcgggcaaagcctgtacgccctggcttcgctggctggcggcctgggcggcagcgcactgctgctggtgctggcgcgggcggtgcagggtgtcggtggggcgatgctgttcccggcgacgctggcgctgatcaacagccattaccccgaagggccggcgcgcaaccgggcgttcgcggtgtggagcgcggcctcggcggcgggcctggccctgggagcgttgctcggtggcgtactgacccaatggtggggctgggaggcggtgtttctggtcaacgttccgctggctggggcctgtgccttgctggcccggcgctggattccggccgatggccagcgcgagcgtggccggcgtttcgacctcagcggcgccttgaccgtgacggtgggtggcacgctgttggtgttcgccatcgtccagggcccggaatggggctggagcgccccggcgaccctgggctgcggggcgctggcgctgttgctgctcggggtgttcgtgtggatcgaacagcgtggccacgacccgctgatgccgctgcgcctgctggcccatcgcgagctgcgcctggcgatgttccttacggccttgttcatgagcagcttcggcgtgcagtactacttcctcgccctgtatttccagcaggtctacggctacagcgtgctgcaaagcggcgtggcgtttttgccggcgacactgctgtgcaccgtgggcatctggctggccgaacgttcgttgctgcgcttcgggctgcgggcgaccctggtcagcgggttgctcctgggcgcactgggcattggcggggtgtatgtggcgctgcccgacggggcggggttctggagcctgatgccgggcatcgtggtgctgagcatcggccagggtatgacctggaccgccatgtgggtttcggccgggcagggcattgcgccgggcgagcagggcgtggcggcgggcattgcctccaccagccagcagatcggcggggcgctggggctggcgctgctggtgtccctggccaacgccgggctgggcggctcacaggcggccggcatcgagcaggcggtaggcgccagcgccttgctcgccctgctgggggcgctgctggccctgcgtttgcgggtgccgacaggccaaggcctggcggcagccgccgaacgcggttgagtggcagccgatgacggcatgcctgtagccgctgccgagcgaagcgaggctgcgcacgaggacgcagtcctcgccaaacctgtgcatgcggtttgccttgaagaatgcattgcccgtctttacggccgctgcgctgccgatcgcagcctcgcgttgctcggcagcggctacagggtgagtcagcgtgagagctcagatccacacatcattggcggccgtgcgttcgccgccttcttcaccggtgttgcgcacgcccttgggttcgatcagcagcagcttgacctcctgttcggcgtacggcttgtgcttcatgcccttgggcacgacaaacatctcgccctggttgatggtcacctggccgtcggcgaagtcgatgcgcaattggccttcgaggacgataaaggtttcgtcggtgtgcgggtggtcgtgccagatgaagtccccttgcagcttcaccagtttgaactggtagtcgttcatttcggcgatgacgcgggcttgccagtggtcgtcgaacaggctgagtttgtaggcgaaattcaggctctggtaagtgatgggcgtggtgttggccgggttcatgctgcggctccgtaaagaggggatcgggcctctacggtaatcagcgcgctgctgcggttcttgtacgattgtgcgtgccgggcggcgttcagcggccgtgcattttcagccagcgcgccggcggcaggccgtaggtcttgctgaattgccgggtcatgtggctctggtcggtgaagccggccaacagcgccgcgctgaccagcgactggccttgcagcaacagagcccgcaccaggtccaggcggcgcatggtcaggtagcgataggggctggtgccgaacagcaggcgaaagtcccgcgacaggctccagcggtcgcggccgctgtgggtggccagttcgtcgagggtgatgctctggtccagagcgctgtgcatgtattcccgcgcgcgctccgcggcctgatagtcgaagcgctgcgtcggtcgggaaacgccggacacggcattcagcgcatgggccagatcgaacagcgcgtcttcctgttccagcgggtccaacgggccgtccatgctgcgcagcaaggtgtcggtggcggcgaacaagcgtggatcggtggacaggccgttcttgatgaagggcagcggctggccgccgagaatctgctggatcagcgccggctcgatatacagcatgcggtaatggaaaccgtcctgggtgccggcttcgccgtcgtggacttcatccggatgcagcaccatggtcccgcccggcaggttgtggcgccagccgccgcggtactggaagctctgcacgccggacagcgtgcggccgatggcgtaggtgtcgtgacggtgcaggtcgtagccatgcccggcgaaaaacgcctcgatacgctccagcccccgggcgggaggcgcgcggtggacccagtctttgcggggggcgggcttgcccatgaaactgtcctcgacacaacgtcaggcccgtacggtaacccaggcgcgtgcgactgtcttcagcgcgtcatccgcccgcgtcggctttcctggcctctttgccgagggtgccaaactcgatcggcgtcttgatgtagaacagcgcaatgtcctcgtcctccaggcgttcgaacagccgggccgactcctcttcggagagtgccaggcggacctcgatgggctggtcggccagttcgaaaaagtgtgcggagtgcagccggccggtgtggccgaagccttcgatggcggtgctcatcgtcgcgccgcgcaggcccagttcattggccaggtcgacgagccagtcccccagcattttgccgtggtagcggcggttttgctgggtgaagaaaatcaccaggaaaccgttcatgagcgttctccaatggcctccattactttcagcatagccccgggggtatcgctgggcttatgaattgaatgatcgagaaacagaaattaattattgttttacgataattaattctttatggtttctcccacattccttcctctggagccttcccatgacgtcccaaggtcttgcccgtttcagccagcgcatgtcggctgtcaccctgttactgatcattgccatgctgctgctcaacgcggcgctgtggctgtttccgcagttgagcgcggaaaatggctatgggttcgggtttggcctgagcaatggcctgtcgagccatctggctgccggtgccgcttttccctggtggcaaaccctgggcggtattttgctgtcgagcattcccctgctggcgctggcctatggcttgagccatctgcgccggctgttccagagctatgcccgtggcgagtatttttcctgtgccgcggcggtgcacctgggcaaggtcggccggggcgtggggctgtgggtgttgctggattttctctgcgagccgttgctcagtgtctgggtcaccctgaacgcgccagtgggcgaacgcctgatcagtctcagcatcactgccccgacctttgtcgcgctgtttttggctgcgtgcatttccatcatcgcgcgtatcctctggcaggccagtgaagtggattcggaaaaccgcgccttcgtgtgagatcagtatgtcaattgtcattcagctggacgtgatgctggcccggcgcaaggtcaaatccaaggacctcgccgcggcgatcggcatcaccgaggccaacctgtccctgctcaagcagggcaaggtcaagggcctgcggctcgcgaccctggacgcgatctgccaatacctggagtgtcagccgggcgacctgttgatccatgagcccgaggtggagtagcgtcagcgtcccccctcatgtgacaaaaggcggtctgtgtcatggcgcttgaacattggctgtatgccggcccgctgctgtcgctggcgttgctctggaccgtggcggtggtcacgccggggccgaacttctttaccacggcgcaattggcagccagctgttcgcgccggcatggcatgacggcggcgctgggcgtcgccaccggcacggtgctttggggcttggccggcggcctggggatcaagtcgctgttcagcgcggccccggccttgtacctggccttcaagatcgccggcggctgctatctgatttaccttggcctgaagcagttcaggcgcaagccaaccctgaccggcgctggcaatggcttgcctggcgagtcgggccgtagcctgttctcggcctatcgcctgggctttctcggcaacatgaccaaccccaagtcggcgctgttcgtcgccaccattttcgccacctcgatgccggcgtcaccgccgccgttgctgctggccctggccgtgctcaccatggcttcgctgtcgttcacatggtactgctgcgttgcgctgttcttcgccagcaaccgcatggctgccgtctatagtcgttcgcgcaaatggctggaccgttttgccggcagttgctacctgctgttcggcgcccatctggtggccaatcgctgaaaccggggccgggtgcacgccatggattttcagggtcaggagacaggacatgagcttcacttttcgccccgtgcaggatcgggatattccacggatctgcggttttgcccgggatcccggcgagttgtttttctttttcccggcggccagctggccgctgacccacgagcaactgcgcgactccattgcccagcgctccgattcgacagtgatcgagcgggacggccaggtgctgggtttcgccaacttctaccactggggcacccacggcacctgcaccatcggcaatctcatcgtcgatcccgaggcccgcggtgcgggtgtcgccgggcagttgatcggcgagatgctgcgcatcgcccgggacaagcaccaggccgcgcaggtgaccctgtcctgcttcaatgacaacgtggcgggcctgttgctgtatcccaagctcggtttcgtgccgttcgccatcgaagagcgccggaacaaacaaaatgagcgggtggcgctgattcacctgcgacatcagccggcttgagcggtccgatacaagcgctgaaccacttttttaacaggaacaaaccatgagcaagctgcgggtcgggattatttttggtggccgttcggccgaacatgaagtgtcgctgcaatcggcgcgcaacatcgtcgatgcgctggatcgcgaacgcttcgaaccggtgctgatcggcatcgacaagaacggccactggcacctcaacgacacctcgaacttcctgatcaaccaggaaaacccggcgctgatcgccctcaaccggtccaaccgcgaactggcggtggtgccgggcaaggccagccagcaactggtggaaacctccagccaggaactgctgggccatgttgatgtgattttccccatcgtccacggcaccctcggcgaagacggttgcctgcagggtctgctgcgcatggccgacctgccgttcgtgggttccgatgttctgggttcggcggtgtgcatggacaaggacatcagcaagcgcctgctgcgcgatgccggcctggcggtgacgccttttatcaccctgaaccgggctaccgcggcgcgcaccgactttgcccaggcgcaaagcaagctgggcctgccgatgttcgtcaaaccggcgaaccagggttcgtccgtaggcgtgagcaaggtcaccagcgcagcggagtaccacgcggccatcgagctggcgctgggcttcgatgaaaaggtcttggtggagtcggcggtcagtggtcgcgagatcgaatgcgcggtgctgggcaacgatcagccgattgccagcggttgtggggaaatcgtggtcggcagcggtttttattcctacgacagcaagtacatcgacgaccaggcggcccaggtggtggtgccggcggacctcagcgaagaggtcagcgagcgcattcgcaccctggctgtcgaggcgttccaggtgctgggctgttcggggctggcgcgggtcgatgtgttcctgacccagggcggcgaagtgctgatcaacgagatcaattcgctgcccggcttcacccgcatcagcatgtatccgaagctgtggcaggccgcgggcatgacctacagcgaactggtcagccgcctgatcgagttggcgctggaacgccatgcggcgcgccaggcgttgaaaatcagccgctgaattctggagtgaacaatgagcgttgccactgaagcgtcgcagtacctgttttcctacggcaccttgcaggacaaggccgtgcaactggccaacttcggtcgcgagctggagggcagcgcggacgcgctgccggggtatgaacaggcctgggtgcagatcaccgacccccaggtgctggccaccagcggcaagacccatcacccgatcctgcgcccgggcagcgcagccagcgcgccgatcccgggcacggtgtttcgcattactgcccaggagctggccgcggcggacagctacgaggtggcggactacaaacgcgtgagcgtggtgctgcagtccgggatcgaggcgtgggtgtatgtgagcgtttgaggcccggggtcagttcacagtcgtagccatgtagtacagcatcgtgcaccacagcgttgctccgagggccatgaacacatagttgatcggggtgaaccgcgcgttgctttcgcccagcgggtcaccggcggcggcgttgaggccgcgctggcccttgaaggtcaccagcgcctggatcggcaacagcaccaggctggcgatatccagccacagattgtcgggatgccttttggacatgccatcaaggccgtggctgatcagcagtatcactacgaactgcgaagccaggtcccacggtagccagtcatggcgacggccgtttttcttgatcagggtattggcttcgcggtacagcgcgtgggtgtagaacagcatgagcatggcccgggcgatgggccacatgggttgtccgctggcctgcttgaactgctgccagttcttgtaggcccagtacagcaggtagaggccgaaggtcagcatgaacagggccatgaacttggtcttggacactacgtagaaagggtgctgcacgtcgctggcagtggccagctgggcttgaggcggggcatagagcttgtcagacacgatcattcctttgtgggtctacagggcgcgcaagattaacccggtgcggcgccaaggacctatcgcgataaatctgaagatgcggtttcaggcgcgcccgatccaggaatactggaaggacttctcctcgccccggtggccgcggcggcgatagctggccagggtcgcgctggaacagtaggtgcagtgctcgcagtgttcgatctgctcctcatcgatgcctgccgcgcgcaacaggttcagggcatagaggctcaggtcgaaccacagcgagtccggccgggttggcgctggcggggcaatctccgggggcagtcgtggcgcggggcgctcctggctccagggtgtccgctccggcgaccacaggtggccttgggtggccgacagggtgttaatgaaatccgggctgacttcgtagcagcaaggcttgatcgacgggccgaacgccacgcgcagctgatgggcggcgatgcccttggcggcgaagtgctgcagcacattgtcgatgatgccgccgtgcaggcctttccagccggcatggaccgcggcgacccacgaggcgtcctcgctgctgatcagcagcggcaggcagtcggcggtgatcaccgcaatggggcgaccggtgcgggtgaacaccgcgtcgccgcggatgatgccgctcggcagggtggtgctggcctccaccacctcgccggtgtgggcctgggagcagaagaacaggttggcgggctttgtcgccccgatacgcgaaaactcgtgacggatgcccggtatctgcttcaacactggcgcctggaaactcatcggaccttcgctctgttgccttggactgctacagagcatagcgggatcgtgagtccttttgctgacagaggcctgtcaactggtcggcagctcgtccgatcgcggcatcagtttttcagcgggatatagcgttcgaccatctgctccggcttgtagtagcgataaccgttgtcctgcctggtcagcgacggggtgaacagaccgatgctgtcgtagtggcgcaaggtcttggtggtgaggccatggcagcgggccatttgaccgatggtgagcatgcaaacgtccttttttgtggtgaaggtcgagcggcactttaggggtttacctaggggcaaactcaaggctgtttcagggtgttttttaagtgtccgagaatctttcagagaagtctggagggtgaataggcgcgggatgacagccaggttttgttcataaccctataacgcgtaagtgctgagcattggcgctttgtatttctatgtgggtatgaacatgaaacgactggtttgccatctagatgttggggggtattccctgacgcaaatagaaagccctttttttgcgctttatgaggttaagcgagcactggcagatccagaggggttaacgggactgcgcgatctgtttgaggcttgtggattgtcagttgggcaaaactacaccgagcaagaccggtgcaaggttctggaaaaagttgaatcgggtgattggttgatggtgtcggatgatcccttcagccccctgagcgctgatacgtttggtaaatactcaaacctctcgggcaggacgttctctttggggagttacaccttgcgccagctttccgcctcggatttgccattggttcagggtgaggtgctcacgctggagagggtggcgacagattctcagaaggtagacggtccgggcaaatgggttctcaagaaaattgattacgatggtgtcaggaattcattagtggtctttgccaaccggctgacttcatttggcgaggaggggcggatgtttttgggagagggaaaggattttatgaatacttcccgaaccttgattcaagagtgggtacctctcactgaggaagagcgtcatttttcacatcagtcttctgttcatcgatatggcgagttgcgtcatatcagtcagcgcttcattgaaggggcagacagctggcctgtctctgggagttcctggcactggcagccagtgaccgctgacgttgtctatgagtacaaaaaggagtggtaatgttttttttcaggaagctgagccggacccgaatctggcagttttggggcgggctcgatgtgctctatttgttgtggtacgtcacgagcagtgtacggctgggcaagactccgttctggaatgacctgactgtggcgactgaagtgctcaaggatcatggaaccgctgctgtggttatggtgatgatcaattggggtttgcagctatcgatagtcgtcagcgctttcctgtttctgtttcagcgcaaagaagccaagtggctggggcttgcacaaatccctttgcgtttggtgtttgtcgtgccgtctttttccgtgcttctgatcggcgcgtatcttttcccgaactacaacccgctgatgctgctggggatgattgtgctgtctgaaatcatcaagggctggattttatgcgcgatcaggaataacccccgctaagggcgagggtgcaaggcctgagtcattggagcctgatcgaggatagaaccgctcagaccgacttcaccggcttgatcaggctctcggcggggatgccgaacagttggtgcagtttccagatcattggcagggtcagggcgcgtttgccgttgagcacttcgtagacccggttggttcggccgatggcgggagccaggtcggcggccgacaggcccgattgctccatgcggaacttgatggcgtcgatcgggttgggcaggtcgaccgggaagtgcttggcttcataggcttcgatcagggtgatcatcacgtcgaagtagtcgccttgctcggtgccgggttcgggctcgttatcgaacagtacggacacctgcttgagcgccacgcggtaatcctggtcggtgtggatggggcgaatctgcatggtcgttactccatttcaacgcggtcggcgtcgatggcatcgtactgctggtgagtgccaacgaacttgatgtagagggcgccaaagcggtaagccacggcgactaccaagcggtagtcattgcctttgatgttgaacaccacgcgacggcttttaagaatgctcgcgctgcaaaactgctccttgatctgtgccggggtggaccagttggcattgcgcgcttcatcgatccaggccagaagcggttgttcgacatccgggtactgttcccagaacgtcttcaaatgactgacggcgataatcctcatggctcgaaatcctagtcccgtcatgggacttaagcaatggggtgagagaggaaggcgatggacggacagccatcgaggctgcccgtcccgcaggtgtggctcagtgtcgatcagcgcctgctgtcatcgcggtgtacacatcatccatcaccgctttacccatctcacccaggtaatgtgccgcccaagcatagcggtccgcctgcggttccatggccgcatccagggtcaactgttttgccagatgtagcagcagcgaggcgtgttccagggcatcggccaggggcacgtcggcgttgacccgcagcagcggacgttggccttcgccacagttggcaaaggttatttcgccgagggtgtgcagggaggaaggggacggattgagggtgtgtttcatggtgaacctccttgattcgaagaatcatcaccatctgccgccaaacagatcagggtgacgggttacgcaggattggcggaccgggaatcaaggcaaccggcgaacccgaaggttctcccacgcaacccgtcataacgcaggtatgcgggcgcaaaaaaaagcgcctgcaagggtgggggcgcttttgcgcctcgattctatcaggccgccaagcctgttcgctggttttgcagcgatggtcgaaccataggttggaagagatggagtcgcaacgctgttactgcgacattctgtgactatgggatatgcgcatttcttgaagccataaaggattctgtagccgctgccgaaggctgcgataaggcccgaagggccttcggcgtcagtaagatcgctgcgcccgttccggtcgatcgcagccttcggcagcggctacccaaaaggcctaacgcaccagtcgaaggcccactggttcctgtagccgctgccgaaggctgcgataggaccgaaggtcctccagcggtcgcaagatccctgcgccccctgcggggtcgttcgcagcctcgcgggctcggcagcggctacagacctgtgttcagcaccttggccatttccgcggtggccgcccagcccaatccggcatacaccggcttgcccacctcggtcgcatgcaacacggcgaagctcagcccgcgctggatgaattcggcttccgccagcttcatcagcgccgaggccagccctcggcgccggtaggcgcgttcgacgtacacattgagcacataaccgcgctggtcctgggtcggatgggccgggtggggcggccagtcgatgctcatcaagccaatggccgccaccggttgctggccgtccagcagggcaaaaccgtagtagcggccatcgggcaaacgctcgcgcagccaggggcggaagtgttcgctcatcacttgcagggccgcgggttcgcctcccgcttcgaggaacatcgcctcgcggtgccggcagaccagttcgaggtcgtcggccaccagtcggcgcacggtcaagccggaaaaatcgataccgccgggaatctgcttcatcgcctgcacctcggccaaaaaacctgatgctaggagcgatcaaaagactgtgtcagacacagaacccaggaaaaatcggcatacagcattcaccccccatgcctgcgctgcgcggcgtgaaaaataaaaagggcccacctcgcggcaagccctttgggttctcctgcgttggcctcaatcccccagcgctgcgccttcacggcgtggatcggcgccgccggcccacgaggttttaccctgggcatcgcgcacccgcacgatcgcctgggtgccgctggtcatgtcgatgtcggtcagctcatgccccttggctttcagcgccgctttcaaccctggggtgaactggccttgttccagttcggtcgggccgttgcggctgccgaagttgggcaggctgatggcggcttgcgggtcgaggttccagtcgagcatgccgatcactgacttggccacgtactcgatgatctgcgagccgcccggcgagccgacggtggccagcagttcaccgctgtcgcggtcgaagaccagggtcggcgccatggacgagcgtgggcgcttgcccggctgcacgcggttggccaccggctggccgttctcttcggggatgaaggagaagtcggtcatctggttgttgagcatgaagccctggaccatcaggtgcgagccgaaggccgcttccacggtggtggtcatggacaccgcgcggccctggtcatccaccgccaccacttgcgaggtggagatgcgcatcggcgagcggtccggggcgtaggcgacctggatgccctggggcttgccgggctcggccttggccatgctgcgctcgccgatcaaggcggcgcgctgggccaggtatcgcggggcgaccaggccggcgatcggcaccggggcgaagtccgagtccgccacgtacaacgcgcggtcggcgtaggccaggcgttcggcttcggcgatcagatgcacggcttcaggcgccggttcgaggccggccggcagatgggtcttggccggcttcaacggtggcagcgcataacgcggatcgcgggcttccagcgcctgcagggtgccgaggatctgcgccagggcaataccgcccgacgaaggcggcggcatgccgcagacctgccagcgcttgtagtcggtgcacagcggttcgcgctccttggcgcggtagccttgcaggtcgttgagcgacaggctgcccgggttggcgtggccctgcaccttggcgacgatttcccgggcgaccggcccttggtacagagcgttcgggccttccttggcgatgcgttcgagcacggcggccagctgcgggtttttcagcagggtgccgacggctttcggcgtgccatcggcattcaggaagtaggccgccatgtccggcgatttcgccaggtacggatcggcgacgatcatgctgtgcaggcgcggggagatcgggaagccctggtccgccaggcgaatcgccggctcgaacagctgcgcccacggcaggcggccgtgtttttcatgggccagttccagggcgcgcaggacgcctggcgtacccaccgagcggccgccgatctgtgcctgggggaacggcatgggcttgccgtcggcttgcaggaacagcttctcggtggccccggccggcgcggtttcgcgaccgtcgtacgtgcgcaccgccttgccgtcccagagcacgatcaaggcgccgccgccgatccccgacgactgcggctccaccagggtcagcaccgcttgcatggcaatcgccgcatcgatggccgaaccacccttgcgcaacatttcgcgcccggcttcggccgccaacgggttggccgcggccgccatatgccggtcggcgtgctgcacttgcaggtcggtgcgataacccgaagcgatttccggggcggggggcagggcggtatgggaaggggcggaagcgttgcaggcggcgaggcttaaggccacggctagcaacgagaaactggcaagccggcggtgacgcggattgagggtcgagaacacgcgttgaactccgttcactgggtaaatgatgtgtcgtccgtggggaggaatgtacaacagtgagcgggcccatgctgaccctttcgctggtcgctacggtgccgatatggctggcgcttctgggcgagggccgatgctggacgctggcctggaggtggcgcttggggggctgtgacggggcttgggctttggtattgaaagcgcggcgcgcctgtgtgcatgggcgctggtgagcgccttgttttctccgttggctggcgcctgggcctggaaccaggcgacgcgtttcactgcattcccggatgccacccggaccaagcgccctactgacgttcggtacgggtggcaagccaaccggcgacaggctgaccgctacaactgaacgagcctgccaagtggcatggctcgaacaaagggggggccggtaaacctggctcgtctcggaccgagatcccgtgcaagcgtagccaggcatccagcgccagcgctgtaacgggctcctgctgtattcatttggatgctaatggggcggtgtactaccgttgaaggttggaagcttacgggatgccaggggccggaggcggacaacccttcattcgtgccgagttcagtcggcacgaatgaagggttgcgcggcgcctacacggcaatcaggtctatttggcgttgagccccactaggcggcgtatcaggcttgtgctttcgcggtagtcgtagtccagcaccaggttatcgcgcagcaggggctcgctgagtgcgtgctgttcttcaaacaccaatgcacgtgtggagtgctcactggcagccacgtcccacactaggttcatcagcaggttcttctctctggcgcccacgctttgcgtgtcaagaaaccaggagaacttctggccaaaggcggcgtcggcggccaagtctttctcgttgaacctgaggatcaagccctgtccgcacagctctctgagcaaatgcagcacccgaggcaatttctccatggcaaaaacccttccggcggccagtgcgttgtggccaggcagcaatatgtcgccgtcggacatctcggccgtttcgatggaggcgatgcacatgcctttgagtatttccgcaagctgcactatttcgctgacccgctggcgaaccaccgcaatcccctcaaggcccaggacttccatgatcaccttggccagtccggcatacaggtcagccttggtttccaggcgcacgagcgtgtaccaatggctgtatgaggtccacagactgaagaagccggcgctggccagttccggcacgttcgccgccatgattcgccagcgtggaatgaacacgttatcgaataccaccatcgcctcggcttcttcacctttggatatgagcgggtggtcataggcgctggcgtgaggctgggagacaatctctcggcaaaaaatcttcacccccggcgcatcgacagggacgtaagcccagaatgactcctcgggtgctgcggggaacaagctgccaacaaatatttcattggactgcggtgctgccgtgcccacgcctttgacgccgctgatccagatgccctcggcgttctgcttgttgatcctcatcacggcacgatcgggcggcggcaggttgaggtcggtgccgtgggtacgtgcccgatagccctgtggatcaacaatggtctcagacaaatacaggctgttgcgctcggcgtagtcatggtattcggtaatgttttctgcgtactcagggcattttttcctgaatgtcggcagatatcccatcatgccgacggtgaagctggcgatcatgtccaggttacggcagtgagtgccccaggttttttgcgagacgtacatgattgcgcggcgtcgcgacgccaagtcttctttgtttctagggggcatataggcagaagaggccaggtaaccgtcggggcgtacgtaagtcagaatgtcgtcgtgttcaccgctgaattgttcttcgtagatttctgcaacttgcgatatgcctccagccgtagagaagtgtgtagtcacatcctcaacaacttggccttgataaataacagtgcggttatcacgcagtgaagctttgaaggattctgcacttttcagatatttacgcttgttttgaaaatctagcatggtagcagcctcagtaatgtctgactttgtttatgtaggttctggcccgatgtctatcgctgggtcaaggacaacgttctagagcaactataaaattcagataggaattaatgtcgttacacactttggtgatccggactctctgtttggtatttcgaatacgcgttctttcgcatctggacttttctcatgttgaccgggtgtcataagtgttgaagtttgcgcaatgagttcgaagctggagcagccaggcacttcaaagcatgtttatcgcgggaccctatggctgtaaccggcgatgtttccagccttcagcgctgcggtcatagcgcaagcgttcatgcaggcgctcctcgccgttaccccagaactccagcgattcaagccgtaactcaaacacgcaataaccctcgggacgcggcagcggaccttgaacctcggccagttccctggcggcgttgcgcatggcttgaacatccttgagttcttcactctggcgagacaccgatgacatcggatgcgtggcataagggcgcttcaaccaggcctcgtcagccttggcatccggcatgcgcacggcctggccattgaggatgatctgctggctggtttcgcgccaatacagcgtccccgaggcccaggggttctctgtcagttcgcggcctttctggcttccggcatgggtgctgaacagtaccccggtgtcactgatctcactgatcaccacgatgcgtgtcgaaggccggccctggctgtcagccgtggccagcgccagcgcacggggttcgcggatgcccacgcggcgtgcgcgttcgagccagttgtgcagcacgctcatgggatcggcaggcggcttctggtactcggggaacggcgcatccagtgtgccggtcagcgattccgacatgcctttacccaacagcggcttgcctagtactgaactgttcatagaacgatggtcccccgtccgaaggtgatgccattgcctgatacttcgacccgcgtcagttgatcggcgcggccctcggcccgggcgaacatgagtgaggggcggccgatttccacgccctgaagaatttcgatctgctggccgaactcgatctggccatgccgcgccagatggatcgccaagggcccggcagcggagcccgtggccgcatcctcgaccaccccataggccggcgagaacatccggctgcgccagcgccgtcccgcaccggcaaaacagttgatggccatgtcgtggaagctgcacagggcacggtggtcggggtgcagggccgacagcgcggcgatgcttggcaggccgacaaacacatgacgcgggccgttgtgataaatctcgatgggaaaggtcgagtcgctgatgcccagggccttgagcaactcggcgtcgcgccccagggccgtccaggtcggtatcggctggtccatgctggcggcgatgacgctgccattctggcgctccagctcaaaggcgatggtgcccatctgggtttccaggaacagccggtgattgtcggtgcgcgcacccagggcaatggccgtgcccagcaacgggtgcccggcgaagggcagttcgttgaccggggtgaagatccggatcagcgcatcaccacagttacgtggcttgagcacgaaagtggtttccgacaggttcatctcccgggcaatgcgttgcatttgctcggccgacaagtcatcggcgtcaaagaacaccgcgaccggattgccttccagcgggacgctggcaaaggcgtcgatgatgacgtaatggtgcatggttatctcccggcggccgaagcgttgttctcgacaggtgtgtggatcagggcgtgccgcagcaggtcggcgatgatgcgcggaccttcctgggtcagcagcgactcggcatgaaactgcatggaggcgaatgaggggccacgcagggcatgcacctcgccggtctcgctgtcgcggctgatttcgacggtgccgatgccgtcgatgtccaggcggtcactcgagctctgggcggcgaaggtgttgtagaaacccacccgttcggcgttgccaaacaggtcgatctgtttttgcacgccctggttgggaatggctttgcgctgcagttccaggcccaggcacaggctcagcacctgatggctcaggcacaccgcgaggaatggccgctgctggctgagcaaggagcggatggccacgtgcaggtggttgattttcggctgttggacttcgctcgggttgccggggccggggcccatgatgaccaggtcgtagccgtcaaagctgtattcgtcgctgaagctgcacaccgtcactaccaggcccagggcccgcagttgcttggcgatcatcgaggtgaaggtgtcttcggcgtcgacgatcagtacctggcgcccactgaagtcggcctggatctgctcccgctgctggctgtccatcagccagaagtccgagacgtaggcattgcggctggccaatgcggcgcgcacttgcaggtgattgccgaagcgcgagggcgcctggtttttcagtgcgctgatcaggccagtggccttggcccggctttcggcagcctcggtcatcgggtcggaatggcgcacgatggtcgagcccacgctgatccgcacctcgccgctgttatcgatgtcggcggtgcgaatcaggatcgccgagtccagggaacgcccgcccttgccatcgctgccgatcagcgcagccatgccgctgtagtacgcgcggccttgcggctcatagcgctggatgacccggcaggcgctttccagtgggctgccggtgacggtgggcgcaaacagggtttcgcgcaggatttcccgtacatcgcaatgggtcttgccttcgatgaagtactcggtgtgggccaggtgcgccatttccttgaggtaagggccgaggacgtggccgccgtcctcacaaatgcgcgccatcattttcagctcttcatccaccaccatgtagagctcgtcggcctccttgcgatccgccaggaagtccatgacttcggtcaggttagggccggcaggcggatagcggtaagtgccgctgatggggttcatcaccgcgagcccatccttgatgctgatgtggcgctcgggggacgcacccacgaaggtacggctgccggtgtggatgatgaacgtccagtaggcgcctttttcccgttccagcagatggcgaaagaacgacagcgcactggccgggccgtactcgctgatctcggccaggaaggtgcgcttgatgacgaagttggcgccttccccggagccgatttcgttggcgatcacctggctgacgatctcggcgtagctcgcgtcgctgaggtcgaagcgttcgctgttcaactggatcggcacgttgggcagcattcccagcaagcgctcgatgctgatggattgctgctcggtgatgttcatcgccagcagcggcgactgatcgtccaccgcctcgaaaccgcgttcggcgatctggcggtaggggatcagcgccagtacatccaggcgaggcgcgccgatcgaggtggcaggcaagtcgatatcggccaggacctgcggttccgacatttcgccgatcagcacgtccagcaggccggggccgctggattccgggcggtacaacagggcaaacggctcgggagccggttgcaggatgcgttccatgaggtgggctgcggtctggctcatagcaccacctcgtcggtggtgatgaccatggcgcaacggctggcggcgtattcgatggccatccagtggtgctccttgctgaagtcggcgatcgcgtcggcaacgaggaacggctggatatcgttggagtaggcatccacggtggaaatcagtaccccgacatgggcgtacaccccgcacaggatcaactgatcgcgctcgtcggcgcgcatgcgttccagcaggtcggagttgaagaacgcgctgtagcgccacttggtcagcagccagtcgccgggcttgggcgtcagggcgccgaccacctcgcggtcggcggggctggccttcatgcccgggccccagaagtccttgagcagcccgcgttgctcctcgctcatgctgccgggttgggcggtgtaggccaccggaacgccgttgtcggcagcccactggcgaatgcgcgcggcattgctcacgacttcgtcacgcagggcgtcgggcaagggccgcaggaagtagcgttgcatgtcatgcaccagcagcacggcacgctcggggtcgatgctccattgcgcgaggttgacgggcaggtcgcggttggtaggcaaggcgtaagggacaatcgatggaatgccggtcatgacgacaaactccagtcaaaaggaggcaagggttgaggagggctggtttttccaggccatcaccgcagtaatggcttgccaggggttcaggcgcgggtcgcacaggcttttgtagcggctggcgacctgatgcaggccggcggcatcggaagcgcactcgctgacgtcgtcaggggtggtttccaggtgcaggccggcggccacgccaccggcggaggtcacggcatgcttgaaggcggcgatttcctcggtgatggcctgcaccatgcgggtcttgttaccgcagggcgcgacaatggtgttgccgtgcatcgggtcgctcagccagatgatcttgtggccggcctggcgcaccgcttcgaccagcggaggcaggcgctcggcgaccttctgggcgcccatgcgggcaatcagggtcagccggccgggttcgcgcttggcgtccaggcgctcacacaggctcagcagctggtcttgggtaatgtccgggccgaccttgcaggccaccggattgagcacttcgctgagcagcgccacgtgagcacccgttaactgacgggtacgctcgccgatccacggccagtgggtagaaccgagaaatacccggccctgttcgtcctggcgcaattgtggcagttcgtagtcgagtaccagcatttcgtggctggtccaggccggtgaacctatgagttgctcctggcctgccgaggctttccagcccaggtgctgcatgatgtcccgtgcggcgctatagcctcgaaccaggcgttgcgcatcgtgctggcgatggccgcagacggcctcgcggccgttgaccatgtcgccgcgatacaccggcaactcgagatcgccaatgcgttcgttgttgttggaacggggcttggcaaactgcccggcaatccgtcccacccgtaccaccggttgctgggtcacgagccggaacgctccggccaggatgtccagcaccgctgctttgcgggccacatggtcgggagtgctttcatccatgtcctcggcgcagtcaccggactggatgaccattgcttcgccggccgctacacgcgccagcgtggcgcgcagcaccaggatgtcttccactcgtatcaatgaggcgctgtccctgaggtaggcctgcgcgtcatgcaattgtgagggctcgctccattgaggctgctggaacgcttcacaacttaaaacccgtttcagtaagtcttccatgatgcgatcactctcacgagggattaagttggaatgccttcgcgcttgatttgcggtactggaatacccagggcgcgcagttgctgaaagacgttcatgaattcgcgattgcgttttactttgccgtcttccagttcgaaggagtgcaggaagtggttctcgtaatagccttccggatagccgggaaagaggatcttgccgtggccatcacactcgacccagatatggttagggtcatcggtttcaaatactttgacgttgtaccactcccagtccgggaagcacttgagtgaccaaacagcatgttcggccaacttggctttgccactgattacaatcggcgcgccggtatcggtggtccataagccgcctgtaccatcttcggtaaatagttcatggcggcgcaggcggtcctggcctttggtgcgcatatattgctcgaccgtggcgcggttcttgcggcgaagttcagtggtgtcgttagcggttagttgttgcgctgcactattagacatgctcaatctccaatgaatcagggggttatgaggcggggataccttcacgcttgattcttggaacggggatgcccaaggcgcgaagttgttcgaaggggttcatgaattcacggctctgcgtgatcttgccgtcatccagttcgaaagaatggatgtaatgattttcgcaataaccttcgggataaccgggaaccagagtcttgccgcgaccgtcgctttccacccagaagtggttggggttatcggtttcaaacacccggacgttgtgccattgccagtccggaaagcacttctccagccatacgccgagggccgccagcttcgtgtggcctttaaacacaaggggtttaccggtttcggtgttccaggaaccgccactgccatcctgagtgaacagttcatgtcgacgcaggcgatctttgccgttagtgcgcatgtactgttcgaccgtggcgcgatttttctggcgaagttcaaggtgatcattaaagccgctaggggaaagcgaagcaggcatgggcagcatcctccttagttggggggatagtgttgaaagtaaatatttagttaactgacatgggtgaatatttacagcgtttaactattgttcctgcgtggcggtgttgagtgggtgttgtttatacacctgcatttcttgggggtggaactaccagatcttgtagtgattaggggcgtgagcgggctggctgcagcccgccggatgaactgttgcattattgtgaagaggcgggttcattcgtcggctgagagacggtaatggcttactaacatcgtccggatgcaatgttctaagtagttagttggattaggcgcaatgaatctagtgctagcgcgaagccgtctatgacggtgtgattttgcttgttgacagagattcaggttggtctagtctaacggcctgttttcaactttggtggtgctcaaaatggaattagggcagcagttgggatgggatgcgtacttttatagtatctttgcgcgaaccatggatatgcaggagtttacggctgtcgcgttgagggccttgcgcgcactacggtttgatttttttgcctacggcatgtgcagcgtgactccgttcatgcggcccaggacttatatgtatggcaattatcccgaggactgggtgcagcgatatcaggcggctaactacgcggtgatcgatcccacggtgaaacacagcaaagtctcgtcgtcccccattttgtggagcaatgagttgttccgtgggtgcccggatctgtggtccgaagccaacgactcgaatttacgccacggcctggcacaaccctcgttcaacacccaggggagggttggggtgttaagcctggcgcgcaaggataatcccatcagtcttcaggagtttgaagccttgaagatggtgaccaaggcgtttgccgcagcggtccacgagaagatttccgagctggagagcgacgtgcgtgtgttcaatacggatgtggagttcagcggtagggaatgtgatgtgctgcgctggacggccgacggcaagacctcggaggaaatcggcgtgatcatgggggtgtgcaccgatacggtgaattaccaccaccgcaacatccaacgcaaaatcggcgccagtaaccgcgtgcaggcagtctcttacgccgtcgcgatgggctatatctgagggtcattcaagaaggacgactcggcctgtatcaagcggtctctctcaataatgtgtcggacatgaaggctgacggtgcgactgcgctgcggtgatgctcgcggtgggccgagagtttgatggcgaggattttttcattctggtgcaccgtgaccgggcccagtcgttcgtagtggacgccgttgattttgtaatagcgctccatggtgctgttgacgatcccgacgatggcatctgcgcccgccaggctggctgtcttgaggcttctccagaacaacggcatcgccagttgcggttcgcgggtggtgaagcgagccatttcccagatggctggatgcttgggcggggccccggcgcaggtatggccgaacactccttcaagcaggttggggaacgtggtgggaatcaggcgggcgcagccaacgatggcgcggtcttcattgaacgccaggaggtagcgggcgtgctcggtgtcgtattgatcccattcacaacctgcctggctcggatgggccggcagccgccatccgagtttctcgacgaactgttcgtgccgaaagcggccgagcatgagtttcagctcgtcgctcatttggttcagtgtgtgctcttccatgtgcattactgaagttttccttagggataaagggagtgcagttttatagaggacttgtaacggcttggcacctgcaagatctggtaggggcatcggtggcatcgaggtgaagccattcgctggggactttgcccaagcgagcggcggcgacagtggcgttgatccggccgccggcattgaaggcggcagtctggcccaggcagtcgtagagaatgattcgtgcgctcatgtggtaaggaggcggcgttttatctcggatggcttcgtttggcgaggatagggggatacgaagagagacagccagaagcaagaaagcccgcactaggcgggcttcttgaggtgattcatagactgctgtagccatctatggaacggtactcaaccctacgaagacaatcccaaaccgtggataccagccggtcggatggtcaatgcctaggcaattgttttagcgagatacgtcgctgtcgatgggcaaagcgacttgaactgttctgattgatttatatggtctggagctaaggcgcgaggacactctgagtagccatgggccttgaagaaatttgcggcagtgttggtaagcagatgcagttttatcgcgccaaaggttgttgccatggcttccatttgttcaagcactgcagctccccagccttggccacgtttttcagattcaatgactagcgagcgaagcagcacatcctgtccttgcccttccagtcctccgtagccaagcggcacaccctcatagtcgaagcgaaagaactgtcgcgcaggtaataccaagtcagcggtaggcaagcccgcacgttcgagagacaggcgcagagcgtctatttggtcagcaccaatcggtaccacttggatgtctaccgcattcttcatgaagagctcccttgaattcggcctaagctggatatctgccgatctggccagcttcagcaacccgacattgaccagctcaaggtcagaggccgctggatgactctgtaacgcagattccttttacggaggtaaccaggctgaggtggttacttttggtggttaccgcgcaattcaatctgatgaatagtggtaggtggctcacgcatgtgaaccgcctgtcgttccctatcccctcggttcgattatttttcgaggatacacagcgggaaggtatagggggagacaaggagatacagccagaaacaagaaagcccgcactaggcgggcttcttgaggttgtttagagactcatggagacatctgtaaacaggtacttggtggctacacagggacttgaaccccggaccccagcattatgaatgctatgctctaaccaactgagctatgtagccaagtggcgcgcattattcgcgtagaacggtaaggcgtcaagcgctttttataaaaaaattatctacgctatcaaccgtttatccaattccctcctgtagccgccagcgcatcctgcgattgcacgcgcaacgcgccgtgaaccctggcccgcgttttagtcgctacaccgtattggccggtttgcgtcggccgtgccgctgaacgcaggcttcgatgttttgccgtgccgcgcatcaagaaaaatattcaagtcgttagcaagctaaggagatagcctcagtgcaccgaaaaatggcacattggccacccctgcaactgcgcatccatctgctgtacggaaactctcatggctatcagcaatgttcagtccgcctctgtggcgactcccgcgccttcacacagtagccccctggtgctacgcatcattggcgcggtggcgctggcgcatttgatcaacgacctgatccaggcggtgctgccggcgatctacccgatgctcaaggccagctacggcctgaccttcacccaggtcggcctgattaccctgaccttccagcttacggcctcgctgctgcagccgtgggtcggttattacaccgaccgccatcccaagccgtacctgttgccggtgggcatggtctgcaccctgatcggcattctgatgatgtcccaggtcggcagctttgccttgatcctgctggcggcggggctgatcggtgtcggctcctcgaccttccacccggaagcctcgcgggtggcgcggctggcctccggcgggcgttatggcctggcgcaatcgagcttccaggtcggcggcaatgccggcacggccttcggcccgctgctggcggcggccatcatcattcccttcggccagggcaatgtggcctggttcggcctgttggcggtgttcgccgtggcgctgctctacgccatcagccgctggtacgccaaccacctcaagctgttcaagctcaagcaggggcaggcggcgacccacggcctgtccaaggggcgggtgctcagcgccctggtggtgctggggctgctggtgttctccaagtatttctacatggccagcctgaccagctatttcaccttctacctgatcgagaagttcgacctgtcggtggccagctcgcagctgcatctgttcctgttcctcggcgcggtggcggccgggaccttcttcggcgggccgatcggcgacaagatcgggcgcaaggcggtgatctggttctcgatcctcggtgtggcgccgttcaccctgctgctgccccatgtcgacctgttctggaccagcgtgctcagcgtggtgatcggcttcatcctggcgtcggcgttctcggccatcgtggtctacgcccaggagctggtgccgggcaacgtcggcatgatcgccggggtgttcttcggcctgatgttcggcttcggcgggatcggcgcggcattgctgggccacctggcggacatccacggtatcgagtacgtgtacttcctgtgctcgttcctgccgctgttcggcctgctggcgatcttcctgccgcggacccgaaaagcctgagtgcaggccttgaacgaaagggcccgggacgtgccgagcttgggcctggccgaagagccgctggcgtgtacagacagtgagttgatcgggaacacagctcgccaatgaaaccatggagtaaggtaatgacccctgaacgtataaccctcgatgccctgttgactggccgcgccgtggcctacagccggccggggtccatgagcgcgatcgccaagaccccgcgcaccggcagcctgcaggtcggtcccctgggcctgctggaagacgagcagggcgacctgcgggtgcatggcggcaccgagaaagccattcatcactatccccgcgagcattacgccgtctgggccgccgagctggggccgcatgcgttgctggagcagccgggcgcctttggcgagaacttcagcagccacggctggaccgagcagaacgtctgcctgggcgaccgggtccgggtcggcagcgtgttgctggaggtgtcccagggccgcatgccgtgctggaaactcaatgaccgctttgccgtgaaagacatgtcgctgcgggtccagcagagcgggcgcaccggctggtattaccgggtgctggaggcgggcagcctgagcgccggggacgtgttgcagcaggtcgagcgcccgttcgagcagtggccgctgtcgcgcttgagcgcggtgctgttttcccgcgaggtggcgctggaggagattcgtctgtgcctggagctaccgctggtgccctcctggcgccgcaccctggagcgccgggtcgagcaggcggcggtcgaggattggggcccgcgcctgctgggcactgagcgggtcgatgaggagtcggcccgctgagcggcgggcgcgatcagttcgcctccagggtcaggcgcgcctggaccatggcctgagggtcgacctccaactgcagcgacaccaggttgacgccctggttttccacctcgtccagccaggtcagcaggtcttgcagcgcgccgcccaggttgagattgaggcgtccggattcttcgctgtccatgcgttcgatgctcaggttggccgcggccgtgctggcggtgatcaggccggccagggtccggccgttggcctgcgggccgcgggcctgggtggacgaagggagcttgagcagatcggtttgcaactgtagggcctcctggaactgctgttcagcctggcgcaaggcctggcgctgcggattccagagcagggtccagaacagcgtcacggccagaaacaggctgagcaacttcagggccaggcgatcgcgaggcggtagctgctgccagcggttcgagtaacgattgaaaagggtggtcatgggttagtccgtgattttcaggcgggcgctgaccccgtcgggagcaagcacggccgagtcggcctgcacattcgcgccctgctgcgcgagggcttcgcgcaggcgctcgagggtggagaaatccggcgcgttgacttgcagggtccagccttgcgcctgttggtagtccagccggcgaacccgcgtatcgccgccatcgctgccggtccattggctggccaggctgtcgagccggcgcgctaggctttgctggggctggccggcctgctgggcacgggcctggacctggcgggcgaggtcgatcacccggggctcgtcggggaagcgctggcgccagagttccaggctggcctcggtcacctcggcggccttgtgttgcagcaaccagcgatgacccacgtcctgggccacttgagcgccgcaggcgatgaccaggattgccagcagcgcccgccatggcgtgcgcgacgggctgcgcggggcgaatgccccttggcgcagatcgatggcctgcgcgctgccccgggccaacagcggccagggcgtttcctcgctgcgttgcaggttgtcgggcagcagcggggccagctcttcgagggcctggtcgtcgagcgccaggcgttgctggcaggccccgccgatcagccagcggtcgtggcagcgcagggccagggcctggctgtccggcaggcagtcggcatcgacatgaatgcgctcggccgtcaggccatggctggccaggcgctccagcagttgctccagccactggcgttgcaggacgaacagccggcagtgccggcgcgcctgcaacggcccacgggccaggtgcaattgctcggggtcgtccagcagccgttcttccagcaccgaatggatggcttgctgcaaccagcggccgctgcgcggtggtacgtcgaagcggtgatggctggcgatttccgccggcagcagcagggtcaggcgctggccggccagcaccgccgcctgttgcagcgtgccgtgcaccggctcgccgtcggtttgccaccaggtgacgggcgagtcgtcgtccacggtcacggtggtgaggtaaagccaggcttgcatggggttactccggaaaacgggaaggggcggcgagggtgcgctgcagtacgctgacctgaccgtcctgctcgatgcgcaggcggctgatcaggcgcaattggcggtcgcccagttcgacatccagcaccgcctggaaatagcggctgctgacatcgagcccctggctgttgatctcgtactgtttcagagcgggggcgtcgataaattcctgcaccgtcttgtagccatcggcgggacgcgcctgcaccagggcgatggcctgggccaggtcgagcttgcccaggctggccagttgttcggccggggcggtgttgaggttcagggctcccggtgtggttctgacccagggccgcaggcgttccatgaccgctgtgtcgacgccttccaggcgcatcaattcgctgctgtcgttccaggccagcggcttgccgtcgaaaccacgcaccgacggcaggcgcctggggtcgtggggcggcaggccgagcacttgcaacaggcgttgataacgcaggcgactgatgcggtcgttgggcgtgcgcagggtgccgaggttgaaacgcgcgccgaggtcttgcagctggatgcggatacgcccgccgtcgatgtcgaaggtcggcgtgctgtgggcccagcgttggcccaggtgtacgcgcttgggctccggctcgtcgcgccagtcgtcgcgcagttggccacgggcccaggcttcgccgctgagcgccagttgccacagttgctgctgcaacagctggttggaactgccgatcaggctcaggcgctggcgggccagcatgtcactgacgatcagggtcgccagggaggtgatcaacagcacgctgatcagcgcgatgcctcgttgtctacaggccttaaccatggtccagccccttgaagcccggcagcaggatcacccgccgcaggccgggataaccgggggcgtcgagttccagctcgatggcctggggcaggctcagcggtgcctggcccacgggccagttggggtgggcctgaccctggtcgtcgatgtagcgcaggcgttcgaggcggacgccatcgagcagcagttgttgcgcggcagtgccggacaggtcgggaccgtccaccgggctgcggtactcgcgcagccattggctgtcgctccagcgataggtgaccagcagcaggtcgttgcgcgcctgctgcaagggattgctccagccgccgcgtaccagctggatgcgcccgggttcgccgatcagggcctggcgcgccgaactgccattgaccggataggcgatggcctgggtcaggtcgcgttcgaagatacccaccgcgcgttgcaagcgccgcagttgcagttcgtgctgatgaatccgctggtcggtgtgcatcatgcgttcgagcaactgatagcaggccaggccgagcaggctgaacagggccatggcaatcagcacttcgagcagggtgaaaccctgttgccggcgtttcatgggcgggcttccaggtaaccggccaggcgcgcgcgctgccgcggcatgggggcgtcggtggagacttcgagcacgatcttcagcaggcgcgggtcgggcgccgcggcggtttcgctggtcagcagccagtcgcgcccggcgaagcggatcggttcctggcgctggctctggggttggcgcatgccggcgcgcagctcgttcaggcggttgtccgccagccactgcgccagggtccgttcgctgaggccgccgttgttgccgatcaggtgttcggtggcgctgtagagcgacagcgacagcacggcgaagatggccagggcgaccatcacttccagcagggtgaagcccgcctgtttattgcaccggggcaagacgcacctcctcgacaccgtcgctggacagcgacagcagcggttgctggcggtactccagctgcaggctgaaggacgagatctggtcgttggccagcacccagagttgcggctccttgccctggtccaggcctttatttgggcctcgtggctcctgcaggttcaggcgcagctcgccgggcagccggtgttccttgaagcgtttgtcggcctgccactggccgccgcgggcgaggctcagcactgtgtagtggtcgggctccaggcgcaggccgtgattgacgttgttcaacaccgcgtcttcgcgcagcaagccaatgaggttctgcaggcgctcggcctcgcgccgggccttctgcccgcccgagtcgctctggaccagcccgaccatgccggccagcaagccgatgatcaccatgaccaccagcagctccagcagggtgaaacccgccattggcttgcgcacttcaaggctcccagttgccgatgtcggcattggtcccgtcgccgccgttgcggccgtcggcaccgaaggaatacaggtcgtaggccgagccttcgcgacccggggcgaggaactggtaagggttgccccaggggtccttgggcaggcgcttgaggtagccgtcggggttccagttgagggccgccggcatgcctgccggtttcttcaccagagcttccaggccctgctgggtcgacgggtagtggtggttgtcgagcttgtagatttccagggcggtggccacggccttgatgtcgctgcgggcggcggtgaccttggcctggtccggacggctcatgatctgcgggaccaccagggcggccaggacaccgagaatcaccacgaccaccatgatctcgatcagggtgaagccgcgttggcgggaagggttgcgcatgttgtgtgctcttcaggtgatgagttggttgaggttgagaatgggcatcaggatcgccaggacgatcaccagcacgctggcgcccatgaagaccagcatcgccggctcgaacagcccgaccagcatggcgatgccgttggacagctgggtctgctgctggtgggcggcacgttcgagcatgccgtccagttcccccgagcgttcgccgctggcgatcatgtacagcatcatcggcgggaaatcgccgctctgttccagggcccgggtcagcccgctaccttcgcgtacggcacgcgccacgtctttcatacgagtacgaatctgctggttggcgaccacttcggcggagatttccagggcatccaccagcggcacgccgctgcgtccgagaatcgccagggtgctgacaaaacgggtgctgttgctggcctggatgacccgcccgatcaccggcaagcgcagctgggcctgatgccagcgcatggccagggcgggcttgcgcagggccacgcgcaggccggcggcgaggctgccgagcatcagcagcaggagcaggccgtagtcccgagcgaagtcgctggtggcgatcaggccgcgggtcagcaccggcagttgctggccactgtcgatgaacaccttgaccacatccggcaccacgaaactgagcaggaagccgacgatgccgaaggccgccagcagcaggatgctcgggtacagcatggccagctgcagctgctggcgggcggcatgccgggcctcggtgtagtcggccagttgcatcagcacctgggccaggtggccggcgcgttcgccggcggccaccgtggcccggtacatcgaggtgaaggcgcgcgggtattcgcccatggctcgggccaggtcatggccttccagcacccgtgcgcggatcgccagcatcatgctttgctgcgcgcgtttgctgcattgagcggcgaccgcggccagcacttcttccaggggcagagcggcctggaccagggtcgccagctggcgggtgagcaaggccagttgcgccgggctgaggcgttggctgctggtcagcgtggcgccggagcggtccttttgcccgcgggccggcttgacctgcagggcgatcaggttgcgttcacgcagcaactggcggacctgccgctcgctgtcggcttcctgcacgccacgggtcttgcgcccggcgttgcacatggcgaggtattcgtaggcggccacggtcagtgctcccgggttacacgtagcagttcttcgacgctggtgacgccttgcagcaccttgtcccggccgtcggcgaacaggctgtgggcatgctggcgcgcgtactgggtcaaggcggcctcgccagccccttcgtggatcaactggcgcagcggttcgtcgaacagcaccagttcgtagatgccctggcggccgcgatagccgctgtgctggcaggccgggcagccgaccgggtgatagagcaccggggcctgttgcgggtcgaggtgcaactggtggcaggccgcggcgtcggccggcgcggcgctcttgcaatcgccgcagagcacccgcaccaggcgctgggcgaccacgccgagcagcgaggtgcacagcaggaagggctcgatgcccatgtccagcaggcgggtgacggcgccgatggcgctgttggtgtgcagggtggacagcaccaggtggccggtgagggaggcctgcacggcgatgtcggcggtttcccggtcacggatctcgccgaccatgaccacgtccgggtcctggcgcaggatggcgcgcaggccacgggcgaaggtcatgtcgaccttggtgttgacctgggtctggccgatgccggccaggtggtattccaccgggtcttcgatggtcaggatgttgcgcgtctggttgttcaggctgctgagcccggcatacagcgtggtggtcttgccggagccggtagggccggtgaccagcaggatgccgtgtgggcgcagcagggcgtcttccagcttgtcgcggatcgcctcggccatgcccagccgccccaggttcaggcgcccggcctgtttgtcgagcaggcgcatgaccacccgctcgccgtaggccgaaggcagggtggagacccgcacgtccacttcatggccgccgatgcgcagggcgatgcggccgtcctgggggatgcgcttctcggcgatgtcgagcttggacatgaccttgatccgcgacaccagcaggcccgccagttcccggcgcgggcgcagcacttcgcgcagcaggccgtcgacccgcaggcgcacggacaggtgctgctcgaaggtttccaggtggatatccgaagccttgaccttcaccgcctcgccgaggatcgcgttgatcaggcgaatgatcggcgcgtcgtcttcctgctccagcaggtcggtgatctgcggcagttgctcggccaggctggccaggtcgtcctggccggcgatctggtcgcccaggccctcggccatttgcatggcgtcgtcgcggccatcgcgatagtgctcggccagcaactcggcgaactgtgcggcgtcgagtatccgctggccccgcaacgggccatggcaacggcggacctcagcgaggatttccaccggcgtgtcggcccggcaataaagccgcaggccgttttccagggattccagcaggaccccatgacgcttggcgaagccaaagggcaggcgcgcgaccgggttcatcggcgtggctctctggcgcgaatgtcgagggtcccatcctgcggggcggcatcgaacagctggcgcgagtcggcgggcagggccaggccgctgcggctgtcgccgttggcgcgcagcttgcgcaggtcgtcgtacttgcgctggctgacgttgacggcatcggcgctgccgcgcaccagggtcggccgcaggaagaccatcaggttggtcttttcggtgacgtccttggtgctggtgaacagccggccgagcaggggaatgctgcccagcaccggcaccttgctgacctgggtcttgacgttgtccttgatcaggccgccgagcacgatgatctgcccgtcgtcggccaggatggtgcttttcaccgagcgcttgttggtgatcacgtcgctggtggtgatgccgggcggggcgctggccagctccgagctttcctgctcgaccttcaggcgcagggtgttgccctcgttgatgtgcggcgtcaccttgagggtcacgccgacgtcctggcgctccacggtggtgaaggggttgctggcgccggcggtgtcggtggtgtacgagccggtctggaagggcacgttctggccgacgaggatttccgccgcttcgttgtccagggtcagcaggctcggggtggacagcaggttgtttttcgagtcgctggacagggcggtgaccagcgcgccgaaattgctggtgccgatgccgatgatggcgccgtccggcagggtgatgttcttgtccttgccattccccagcagggtaccgatcgacaggccggtgccactgaagttggtgccgccggcgacgttgccggcgcgcgcggcccattgcacgccgagggcttcgttgatgtcgccgctgacttcgacgatggccgcttccaccagcacctgggcccggggctggtccagctgggtgatgactttatcgagcatgctcagttgcgccgggtcggccatcagcaccagggcattctggctttcgtcggcgctcaccagtatcgagttaccgccgcccttgccttcgccgccaccgcgattgccgtcttccaggcgcttgccaatgccgtcgagcagcttcgagagttttttcgcatcgctgtggtgcaggcgtaccacccgcgcgctgtcattggcattgctcggcacgtcgatggccttgaccagagcggccatgcgctggcgggcctgggcggagcccgcgaggatcacccggttgctacgggcgtcgcccacggccttggcgtcgctggggccgttgcccgtctggctgatgctttcgttcagggtccgggccacatcgctggcccaggcatgcttgagcgccacggtgctgaacgagcggttgccggcctggtccagttcgctgaccacctggcggatgcgttcgacgttgctggcgctgtcggaaaccaccagcgcgttggagctggccgagggcgcgacataggcgtcgtcgctcaccagcgggcggaccaccccggagatttccgcggcgttggcgttgcgcaggtccaggacccgggtcacgaactcatcgcccgattgctcgctggatttggtcttggcttccaccgccggcacgatcagcacccggtcgccctggtccagggcgacgaaaccctggctgcgcagcacgctgaggaacagcgagtagataccgtccttgtccagtgcattggacgattgcacgctgaccttgccttgcagccgggcatcgaccaccagggtcttgccggtgatttcaccgacttcgctggccaggtcgcgcagttcggcgtccttcatgttcagcgtccacaggcgctgggtggtgagggccgcgctactgggcatggcactcaaaagaaggccgaggctgagcacggcgcctgcaatcttggacagtttcatggtgtgttctctatcgctcgcagaagggccgtggcttttcggtcggcgacctccggtggggttgtctgggggctgagcaggcgcagctggcgcccgggtagcagcaggttctgttcacggccgttgcgcagcaccaccacctgatcggcgctgacgctcttgagcagcgtgccgtcgggcaggcgttcgcccggggagtagaaggcccggctgtcggcgtactggatcagggccctggattgttcgggctggttgcccagcaggctggcgagcaggaccagcggcaggctggcctgcgcgctgtcgaattcgaccggcacggcgccgaacaccctggcgatgttgcgatcgtccaggggcgcgggcagcagcttttcggcgctggcgctcggtaccgcgttcggcaccggctggcccgccacgacttgccggtagctccagctgtcgaggccgagccagctcagccagagacccagggcgaccaggctggcgggcagcaggtagcgttggccggagccgcgcgggcgccatgagagcagcgttttcatgggcgtttgggcagcatgcgtttgagcacgccgtgcccgcgcatttggtggaggatcaccgcggcgatatggccggccaccagcagggccagggccatgcagctgtaatggtgaagctcttcgaaaaaggtgatggccgccgggtcctgcaagggttgcgggagccgcaggccgaacaggtcgatcgggcgcgacatcatcagcacgccgctgagcagcacggtgccgagggtgaccagcagggcggcatgcccggcatgcaccagcttgcgctcagccgcgctctgatgggcgggcgccgccggagcgggatggcgcacgaggtagaacagccgcaggacgaacaacggcaccagcagggtggtcagcgagacattgataaaggcgatcgcctgttggaccgagcttggcggctgcaacagggcgctggcatagccgctgatcgtggcccatagcacaacggcggcgaacagccagtgcagcagcctgcgcggtcttgagtagtgagggtgattcatgtcgattcccaaggtccgcaacgcggtgccggggcaccacgctgcggttggtcaggttatggattacttgcgaatccaggcgtccttccagttgctgccaacgccaggctcgaactgagtcgcgccagcgttccactggatgcagtagccgctgtaagggaacggcttgcactcatagacgttgccgtccttggccaggaccttggtgccggccttgtagccggtcaggcctttggggaagacgaagtcgtaatcaccgccgccgcccacttcttcggctttgagggtgatgcgctggctttgttgcagctgctcgcctttctccggcttggccacgactaccacgtcgtactcaccttcgctgacgttacgcagcgggatggagaagtgcggcgtgttgttgccaggctcggcttgtacgtgagcaatgctttcgttcttgccgttgaagaccgtcgagctgatggtgtacttgccgccctgggcaatggcgttgaagtgcaggtcggtggcgttgtccttcaaggtgtactcggcctgcaggccggaaagtttcagctcgccaggaatgctcggctgctctttctggatttccacacgcaccacgtcgctgttgttcttggcgtacatggtgttcttgccgtagttgggcacgacttcgttgttggcgttgagctcgcccatcacataaccggcattggccttgttgaccttttccgccaacaggaacggccaggtgttggcctgggcctgttccgcggtctcgatgttcaggcgggtctggcggttctgctgttcgccggcattggtgaacacgcgagtgctgaccttgtcgccgacttgcagttgttcaggctgtacggccccgaggattttccagtcaggaatcggcgcgccatcgttgtcgatgttgacgtcgatggcctggtagaaggtggcggcggtgtcggcgattttccaggtcgccaggatcacgtggtaaccgctgcggtcagcaggaatgttgaccttgtgcttggtcttgccaccggccggcggacgcacgccaccggcgttttcattgagcagcggggtcatctcgaaggagtcgcgggtcagcggctggttcgggttccagtctttcttggtgatgtagaactggtagtaggcgctggcgtgaccggcggagtagtgccaggtgaattcattcatgcccggcttgatcgtggttttctgccagcgggtcgccgtctgctcgttgagctgcgagaagctggtgatgccgcccgccgggatggtgccgttcgccggaccgcatttggtgaagtcgcccgagcagtagtccttggggtagtgatgctggaccgatggcgagtactcgacactctgcggttcgtaagtgacggggccgcaatcgcggttgaggttgccgccggtggcggagcacatgaaggcacgggacttcggactttcgacataaccgtgggcgaaggcttgctggctggccagtgaagccaggccgagggtgatggccaacggaagcttgcgcatggcgctggcgcgggtgttatgaagcatcgaatcaccttgaattagggatgtgaaagagtcttttttgagttcttcgatgccggccgcccaatgagtcgacctggagtgttcctggtccgcggcgcccggtttcgaagggggcctaggatgccgagcggggcttttgtcttgtatgagacgagtacgaaacggcgagccagggaatggaacaaaatgtttcaggggggcggcctggggttgcccagggccgggattgttgctcagggctgtccgggatgggtcaggcgtggcgttcgatatcgcccagcatgcgttcgatgaccgagagcaccgcgtggcgttgcgcctccagggcctgctcgccttcatgagtcgcacgttgcaggtcgaggcaggcccgcatcaacgccggcgaatcgaccgtgcaggccaggccgctgacccggtggacccactgttcgaggaactccggcgtgtcgggcggcggggcgctcagcagctcgcgctcctgttccaggttccggcgcagctcctggagcaagcgctccttgagctgcggatcgttctggaaaccctccaggtaggacaggtcgaacgtcgcggcagcctcctcgtcgggcgctggggcggggggcggggtgaggggggcgttgagggatgaactggatagcccgggcgctttcagcttgccgagtatttcccgcagacgctcgaggacgatgggcttgatcatcaggtcgtccatgccggccgcctggcaacgctgcttttcgtctgccagggcgcgggcggtgtagccgatgatcgggatcctgggtagcccgcgcgcctgttctgcggcacggacattgcgggccagggcgtagccgtccatgtgcggcatgttgcaatcggtgaccagcacatcgaactggccctgttcccaggcttgcaacgccgccttgccattgctgacgtaggtcccgcgatggccgagcctgagcagttgctgttcgagcaccaggccgttggtggagacgtcgtcgacgatcagtacattcaacccggccaccgccgtagcaccttgaagggcatgctgcggctggtcctcgtccggttgccagggcagggtcagttcgaagatgacccggcaaccctggcccgctgcactggcgaggcggatgctgccgcccatgagttcgaccagctgtttgcagatgctcaggcccaggccggagccgccgtgcaggtgggtgatctcggcgtgggcttgctggtaaggcgcgaaaatctgcggctgctgatcctcggcgatgccgatgccggtgtcgctgacatggaacatcaggcggctttgccgaggccccgagtccagctcctggaccgacagttcgacccagccctggttcgtgaacttcaaggcgttggacaacaggttgtgaaggatctgcgtcaggcgcagggcgtccacctggtagcgccgctcggggggcaggcggtgtcgcagcttcagctccaggtgtttttcccgggcctgcgcggcgaacagctcaaggcagttggccaatagttgatcgagggcggtggggctgggcaccagctccatctggccggtttcgaccttgtccagatcgagaatgttgccgatcaggtcgatcatcgattgcgctgactgctgggcgatgttgaggttttgcgaaggggtggacgcgccgctggtttccagctccagcaggccgaccatggcattcagcggggtgcgcagctcatggctcatggtcgcgaggaactggcttttcgcggcgctggcgtcgactgcctgctgctgggcttcgagcagcttgtgttccaggtgcttgcgcacgctgatgtcgatccagccgcccagcaggccctgctgcttgccgagtgcggtgtagaagggcaccagccattggtagatatgatgggcctggccatcgacctcgatcacgctgtcgaggaattgtgactggcggttatccagcagccgttggtgctgctcttccagatccagggccagggcgcgtggggcgatgccttgctcttgcggcgtggtgccgcgcatctcgtccagggaccggccgaagaactgctcataagcgtggttgcaggtgctcaggcgcccttgcaagtcacgcacgtaaagcgggatgggcaagccgttgagcaaggcgaactggaaggccagttggtccttgagctgattctgcgcgacgcgccgctggcggatctgaatccgcaggcgccagttccagtaaaacgacagcagtaccagcaccaggaccagcgcggcgctttgccagacccagctcggcagataggcccagagcgaacccttggtggcgggccgcgccaggatgctgatgcggtgctgattgccgtccgaagttttcaacgaatacaggagcttgttgagaatactcaggagttcggggtgcttggccgatacggcgaacaccaggggctcggcctgggcctggaactgcttgccggcccggagccggggattgtccagctgttgggcatcggctgcgctgttcagcgtggcgtcgaccatgccctgttcgaccagatgcagggactgggagtagtggtcggtgagtaccagttcgatgttcgggtagcggctctggagcagaggctgcaggggatgtccggcggcgatcgccaggcgcctgccccccagggccgccagcgaactgggggaactggcgctttcgcgggtaatgaaggcccagtagtcggtgccgaagccatcgctgaataacaggcgcttctgccggaccggagtcggtgccagcgacagggcgatttgcgcctcatcccgttccaggcgctggcggtcgatgtccggggactggctgtcgatgatgttcagttgcagttgatagtcgtcggccaggctgcgcagcacattgaacgccagtccggcccattggccgtcgtccttgcggtacaggtaattggggatttcgtgggcgatcaggttcagcgaaggaagatgcttgagccagttgtcttccgcgctgttgagggcgaaggagtcggtcggcgcgaacagccagggcgagcgttcccagtgctgcaatatctcctgcttgcgctcccgggaaaccgtcttcagagcggcgttgatcaggggcaccaggttgtcctcatgcccgcgggcggcgaagctgaaacccatggccggcagattggcgacgtacttgttctgcaacttgaggttggccaggctgcgcatgtagaaattggtgcgcagctgatcgccgatcagggcgtcggcttcgccgtcggacaggcgctgcaggccttcgacaatgctgttgatcacgatcagttcagccttgggataggccttgccgactgtttcagcctgcacatagtaggccggaaccagcacgcgtttgcctgccaggtcaggggacaggtccttgtcggcgatgcgcccgacgatgatcggctcgttgtccaggtacggcttgctgtagacgaacccagattgttttctttcgtactcggtggcgcggggcatcagatcgatgtccccgtttgtcaggccggcgatggcactgtccaccgaagggtagggcacgcgctggatcggcagttcgagaaactggctgatgtgttccaggtaatcgttggtgatctggttgagcacatcgttgccacgaggctcgggttgctcgttggaggcgctcacttcggcgacccgtagcgggcgagggggcagcgtctgacgcatggccatcagcgtggccagggacagcggagcaggctcaggctcggcggcgcccagggacgcgacactggtcagcaagagcatgatccagaggatcaggcgcggcaggccggctggagggttcggcatagtctcaggccagcccgacttcctggatgtacaggtagaggctggcgttgctgtccaggcccagcttgcgcatggcactgctcttctggctgctgatggtctgcttggaacgattgaggtgcgtggctatttcattgaccgacagcccggcgccgtagaggcgtagcacctcgacttcgcgaggggacagttgttcgacctcggccagaggctccatggggtcgaacagatgccggatggacggggagacgaagggtttggcctggctggcgcgaatggccttttgcaggtcgccttgtaccccgcgcttgctgatcaacccctggacccccagcttgaggatcgaggccagcagcgccgggttgttgagcatggtcaccacgatgaccgcgatctgggggtaacggcggcgcaactgttcgatcagacggaggccgtcggcctgttcgctgtggggcatcatcagatcggtgacgaccagatcgcagggctgttcggccaacagctggaacagcccttcgacattctgggcctcgccgacgatctgcagtgtgctgtcgctgctgagcgaggcgcggatgccaatgagcgtgagcaggtgatcatcggcgatgatgactttcttttgcatcttgtggctgtccctatccagtcatggcaatgagcgagtgcatagagttaagcagagcggttgcaagtctctgcttgtatcggcgctgctgtgggtttcagcagaagtactaccaattaaccttggccggaaacgggcatggggcatcgtcggagagtggagcgtccgggaaatattggcaagaggggagcgttgagtaacggtgggttgtcgtgacagctaccgggtgaaagactcgcccatgtgcgatagaaccacgcaacgagcccctggcttgtcgtatcaagccagggggcactgctgttgcaacgttggatcagacgttgaagcggaagtctgaacggtcacccgccgggaagccccgtatttactagctctccacgacagaagagacaagtcgaaacctcagcaccttcggaaagtacccccggttgtacccccaaattgaatgcgtgggggtatcgcaattagaggtgaatcatagaccggtgctaccgcgtttgtgaagtcgaaggcgcggaccgcaagaatagggtatgtgccagaccgcattgttggctgacgtatgtgtatccattcgatgagatgcgagggcacgggccgttgtggcccaaaccctggagctttcacatggcagactatcgcagcgacttcaccccgcaggcccccgaagccctgttcaccacgcctacggcactcatgctcgacatccgcctcacgccgttggaacgcaacggttggcaggtactgcgcatgctgcgcactatggatggtcgtagttcgttggccaacctggcacaactgcggcgctatctcacctctaccccgctcgggcagcgtgcgggatacgaaaccgcctggcgtgtcttgatcgtgctgcggctgacgggctggattagcctcgtagggcaataccgtgacccgctgagtggccatgtcctcagcgaggtttatcaggtccacgaaagcgcgctgacgttccagcaggcgtgcgacctcgaccccagccttccgcagcttctgcaagcttccatcggccacgaaaacaatcaggtggaccgcgtagccatgcacatcagggacgggcttgagtctatttccgcagtgcctgtcgataacggccaaacgcgtcgcaatgaagatgatgacccgccgtcatccccaccgccatcgcaagggcagccggtggcaacgcaggctacacaatccgttgagcctgccagcgagtcgagcgttccgcagcagaacgaccccgaccgccacacgatgcagcagcacagccctacgtataaagaatataagtataaaaatacgtacgtaccgcgcgcgcatacgcgtgagcctggcgtggcgttgccgttgccgccgtgcctcgaacgcgtcgcagaggatcaacggcgcgatatgcaaaccgctttgcggcgtctgccccggcaagtgggccaggaagtcttgcaggagctggaggctcgctacagggacggaggcgtgcgcaacgtggtggcctacctgttcgcgctcatccgtcgtgtgggtcaaggtgagttccggctctgggcaggcaagcggctggccagccaaacgcagcaggcggcgcaacgcatcgccagcggggaggtacaagcttcgccaagtaccccggaaagcgtggcaacggtgttcaagcccgctgtgcccgaggtcgtgcgctcgtgcctggattcgatccgctccatgctgcacatgccggtgaaggtgagcgatctggcggcggagctgatgcagagcgaccattggaagccaagccccgcctagcgcctgggccagccttcgcggcctgcggccttgaccaagaggcgctgcctcttggaactccgttctcgccgaagggcaagggtgcaggggtaaaagctccctgcaccccgccgcaaggctggggtcgctgcgtgggcctcaatggtgcgctgcgccgggtgctcgcctgcggctgcgctccgctgcggcctgcgcgcccgccattgacccccactgcgctcatcccagacatgctgctgtacaacggagctgcccgcgctgggtgtgcaagggggaacccattgcgcgcccagggcggggagccgacaagccccgtaggggcgcgtcagcaggcacgcatacggttggcccagcctcttgtgcggggatgctgccgcagcgcttttggccttttgcacggaaccccagcaacgcgagggggccgtcactgcttcggcagtgacggccccccggaacctgcgcgaaatatgggcttgatggcaatcctattgtttgcggcatacgtgacgatgcccacctccactggccctgcactacgccaagaccgatgggcgttgtacatcggcgaccccaaagacgcaggttcccgcaagcgtcgccctatccagggtggaaccatccccaggcgtgctcaggctcccccgcatgccgcctctacccatggggcagagccaactttctccggctgttctcatccaccttgcgcccacggcgcgctattccgatggccatgtatcgggcgcaacgctcgcgaccggccttacccgtcccactcactttctaaggaggttttcatcaccgctactggctggtttggtcttttgctgtacctccgtcctgtctccctccagggagcactgcggacgcctcatcttcgaggcaaaccggtgttctgagcaccatgcccttgtccttcgggagcctcgccttggcgagccggcaacttcacttaccgattcaatctcagaaaaacaagacaggacacaaaaccaatgggggctgtatggacgatctgacctacgggttgcgccagctttgccggcgcaaccgggatggtagtcatgcgacccaggctgaccggctgcgcgggctgacgctggtggctcaacaactcagcgaggcaggctttcggcggatggggactggctcgatcaagggcaagcatgtagaggcgctggtagagcgctggcaggctgaggggctgtccgccggtacgctcaagaaccgcctggcgcatctgcgctggtgggccgagaaagtgggcaaggctggcgttatcccggccgacaacacgcgtcttggcatccctgagcggcagcacgtgaccaacgccgacaaatcaaagacattgggcgatgcgctcgacggcgtgcgtgatgcgcatgttcagatgagcctgcaactgcaacaggccttcgggttgcggcgggaagagtccatcaagttccagccagagtatgccgaccggggcgaccatattgcgctcaaaggcagctggaccaagggcggccgcgagcggaccgtgccgatcaccacggccgagcagcggcaggttctcgacttggcacacgaactggccggagcgggatcgctgatcccggcgcacaagagctacatccagcagcgccacacctacgatgggcagtgcaaggcggccgggctgagcaatatgcatgggctgcggcataggtacgcccaggaccgctatgaagtgatgacggggtggaaggctcccgccgctggcggcccttcggcgcggtcactgacacctgcgcagcgtgtcatggatgcacaggcgcgacagaccatcagtcgcgagctgggccacgagaggacgcagattacagcggtttacttaggcagatgaccattgctatttggcatcaagcgctcaatggatctgctgatgccgtaatccatcacgaatttcttcaaggtccacatccttaagccggtccagaagcgcatgaaattcctgctcgccactcagcatgcaaatgaagatggcacattgactaaggatcgaattgatcagcaagagctggtcttgcgccgtctcgcacttgagcacggctgacaggatgagtgaataggctcgatccgcatgaatgctgggtttggtggtttcgttgtgggaactggtcatgcaatccctccgcgatctcgttcttcgcaccattcgcgaagtgagttcagcggatggtgacgacccgcaggggtgacaaaccggcttattaccagaccggccaggcgcgagcctgccctacgggtcgccatagagcgtcccgctagtaataaattcgagttgtcacacccggcgccgatatgcggcgcggcgcaaggattgcacaggccaatttgggcaagcaactaaaagctagaaaatttcgttgaaccttgtgcacggagactcacgcccataggagcgatgagaaggtcgctctgaattcccgcaaattttcagataattcccacatacattcaaaacgcaaattgctagcgtccgtccagcaagcccttcaggcccttcaagagacctgttagcggtcccgttgtccggcttaaggaagagctaaatgtttgcgcccgccaatactgcgcacttcacgctatcgatcccctccgtgcgcaatgacttcaaggtgttggctttcgacggcaccgaagccctcagcaccctgtatgcgatccgcgtcgagctggtcagcgagaaccctgacttcgacctggaaagcctgctcaatcagccggctattctccagttcggtctgaacggcgaaggcattcatggtcacatcgaagatgtgtacgtgggggaagcgggcaggcgcctgacgcgctatcacctgaccctggtgccggtgctgcactacctgcaattcagcttcaaccaacggatattccagcacctgacggtgccgcaaattatcgtccaggtgctgggtggccacggcatccagcccgacgtctacaccttcaacgtcagcaccagcccggagcacgaatactgcacccagtatggggaaagtgacttcgacttcatccagaggctgtgcgcggaggacggcattgcctggcatcaccaacattcggccgatggccatcggctggtgttcaccgaagaccagacctgtttccccatgctgggcgataccccgtaccagcaggacaccggcacggtcgcggaccatccggtggtcaatcgtttctcgcagcgcttcaacactcgcaccagcacggtgacgcggcgcgactacgacctgaaacgcccgagtctgctgctcgaaagccagttcactgcggacttccagccggcgctggaggactaccgttaccccgcatcaatcaccacgctggagcgtggcagagtgttggccaggcaggccctggagcggcatcgcgtcgattaccagttggccgaaggccaaagcgatcaaccgatcctgcgcagcgggcactttttcaacctgactgagcacccgcgcaagagctgcaacgacttgtggctactgttgagcgtcacccacgcaggtcggcaaccgcagtcgcttgaagagtctgtcaccagcgatacccagcccgaagacggctttacccagggctaccgcaacagcttcaccgccatcccgtgggacgtatttttccgcccgccgttgctgacgcgccggccgctggcgggcagccagacggcccgggtcaccggcccggccggcgaggaaatcttttgcgatgagtatggccgggtgaaggtcgagctgcattgggaccgcctggagctgggcagcgacaagagcagttgctggctacgggtagcctccagctgggcgggggagagtttcggcgcggtgaccatcccacgcattggcatggaagtggtggtgagcttcctcgaaggcaacccggacaatcctttgattacgggcgtcgtgccgaacaaggccaccccggtgccctatccattgccggcaaacaaaagcaagactgtgctgcgcagccgcagtacgccggacagcggcggctacaacgaactgtcgattgaagaccgtgccggacaggaaaaaatcttcctgcgtgcgcagcgcgacattgagcagttggttctcaacgacagtgacaccaagattggcaacgaccggcgcgagcagatcacccgggacagtcacagcctgatcgaaaacgaccgcttcgagcaggtcgacatgaacagttccagcctgatcaagggcgacgaactgcacaccacccaaggcatgcgcaacacgcagattggtggcaatgaactgctctccatcacgggtgtcggcagcatcaccgtagagggaacgtgggtcttgcaggcggggccccaggcccgcgtcactgccaccaatgtggtggttgatgcgagcgcaagcctgacgctcaagggcggtgagcattacatggtcatcaattcaggggggattttcaccagcgtgccgatcgttcagggcggggcacctgtggcgggagcttcgccacttcaggcaattcaggctcaagccctatcggcacaacccattgtcgccccagcgctccccgccctgatggcagccacaaaagccaaagacatcgacttctgcccgatttgcgaggcttgtaaaaatggcttttgcctgcccaatggagtgaacacgtgatggccgtcttagtaaaacagtggttgactgaacaactcagactcggccactccctgtgcctgattctggactccgcagatgaacgtgctacccggcaggccctgctgggaaaccacgaccccgagcagtattgcagtgtgtaccgcgggactcaggctgccgacctggctgacgtggggccgctcatattcgtcatcgacaagcccgatggcggatacctgaaagaattgcttaaggcgcccgagcgcaattggggatggcttgcgagcattcataatggtcgtctgcccgcgctgacccagcattggcgggatcgtatggtcattggtacgcgccccaatcaggcgctgtatcgatttcaggataatcgtgttttgagccgtgccttggggcatatccctaaagcagaccatcctgaatacctcggaccagcgatcagtgtctgttattggcagggtacacagtgggcggtcatccataaccatgcccccggagaatactcggttccgactgatccctcgtggttgaacgtaccagccccgacggagcagacgatggatattcttcagacaaatatctaccgctatctgtgggcggaacgcagcaacgatctacttcggatcagccaacaccaagatccaaagacttggctcgcagaacaacttgctcaggcccagcaatggggatggcttgcccctgaacaattgcatttcttgattctgcaaaacctgagtccgactgaacctccaatcgtaaaaaattggttgcctaaggctggtgaaacatcccaggctcacttcgaacgtctttttaatgaagtgaaattctggtcaggagaggaatctgcatgatgcatacacgacgatttagtccccttgttttgagggccttgtttgtcagcgccatggcgtccgcagcaacgggttgctcaatggcgaataccgagagtttcaccttccaagccgaagttcccgagaattttgtcgttgatggaacggcttattacatccctgcgccgggagaaacctgcaaagccccttcaggtgaagaacgcaaaggccctgggcgtaaggttttcaaaactgagcagcccaagaccgcgcacttggttgatttcaaagtgccgttgaccgacacaggacacggttgctcaatggtattgaagagcctggagttagggattgaagggcaatggggaaaacgagacctggacatgagtctggagtctgccggcatatcgatctccgacgatccgtcagaaagcccatctccattacctagctcagctcctttggtctttcaggggcagtgccagtggttgttccgcactgtcggctcgaaacgatttatcaggaaaatcctgcaatgccgggcactcgacgccaatggcgttatgcagaaaaacctgatcggtacaactgtgcagcgtactcagttagcgggcaggactgtcaagttggtgctaagtgtcgcggaaaaagagcagccgtatttcggccgttcgtggttagaaacatctaaaggctggaagccttgcatagaaacgaaagaaaccttccgctgccagtctccaccgatatttaccgatttcaaaatgcctgatggacgtgattgcaccgtctaccccaactgcaccgaataaggaaatccaacgatgagttcgtacaaacccatggaggattgggagaagccgtcctttagtggaaaaatgttcgcctgtccattacaaggtcaatggatcagctttcagttggtggatgagttcggtgatgggaagccatatgctggtctagcatatattcttcaggacagcgcgaagcagcaatacataggaatgttggatgctgaggggtatgccaaggtccacgactgctatcgaggacccgtcgtcttaatgctagacaatgaatatcaaggaggaattgatacttggtatgaaaaaaacgtggatagaaaatcttatccactacccattactgaacttcaggtccgagctgagcagacccgattttttcacgaagatggagtccgcgtcgagcataatcccgcacaaaaaggggcagataaattcatccaggtggaagtgcgagacttggtaaaacaagtggcacatcttccccctgtcgtagatcgcaaatacccaccagacgacatcctgacaagagcattagatgagctttcgtttgggcctgaaccactttcccaatttggcgtcgggctaatgccgaatgagcacacggtactggaagttcgtccactacgcgccctcaggcccttgttatcgaccgataatgcgttcagtgcattgaatctgtaccaactggcgattatggctgatttgagctattccgattttggtcaagatccccaaaaaccagtggattacgtgcgcttcccagatgatcctagcgtcggcaatttttttggtgaagcactttcaaactttcgtgaaagctggaaggtagatagagcgcagtcgccgattcaccgttgctttccactgtacgaggaagttccctactcgaaacgcttcgagattttacccttcgatccagcggtgtacgaacagaacaggccgggcgacaaacaggaagatccttcgaaattacactttttcgatgacaagaataagttctggtttagtgggaaaagtactcaagcctacatcactcatcatgacgaaattattctgattggtgttcgtggaacgctagaactatcagattggtggcgtgatgctgatgctgcacaggtgccgttcgaagaaggcaaagggaaggttcatcacggcttttatgatgcctataaggctttgaagaagttcatccaggactatttggaccagtttcacatcggccagaaaattattatctgcggtcatagcttgggcggtgcgattgcattgttgctcgctgaggctcttcgtcaagcccccgataacgactacgacatcctcctctatacctacggttcaccacgagccgctgatgccgagttcgtcgcggcagcatctgcgttgccacaccatcgaatggtgaacaacaacgatatcgtccccggcgtacctgcaccctggatgaatgtccgacgaaccatctggttgccggggttagcgtcagtatttattaccaatccatttttaggaattttaatcttcgccgtaggcttggttcgtatcggcggtgcgccctacgaacaccatggcgtattgcatcatttcatgcccgtggattttactggcaaggagaaatcagcaattctctggaccccctgcgcggcctctattgaggacgccgcctgcactcgcgccattgcaaaagatggcgacctaccaatccgagataacttcattatgcaagcaatgcagacaggggatcacagtgctccgcactcctatatccctttcgcttgggcgacattacggcgttggcaacaaaccttggaacatggcgaaaccgttgtcactaaacgcgagtacgatttggtcaaagctgcattggagaatatgcagagcaaggttcaggacgaatgtaaacaacagatggacacgcggcgatatcagaataacgaccgacaatgccatagaaccgtgtctgaattatctgaagagtcacaaaaactcagcatcacaatcgagcgccttgaaatgcagtataagcgtcatctgacactcgccgatgtttacggcagcgctgcgcagtcccctgcactggaagctgctttaaagcgctggatggcgaaaaaagaaaataccacccaggttcagattgcaatgatccctagacagtttgacgacgatttgatgatcgcctctcgaaccggcgcatcttatacattagacatcgactctattgtctgagacctgagatcaataacaagctgatcgggagagcgagcaagtctccctattactcgcgctcgataactttaagcaactcagtgcgccgctgcgacattggaccgaagatatcggttacctcccacagatcggcacctgagtgtagcgaatctagaatctccgcccagtcttgcatgatcaggcgtcgagaactcaagaaccttgcatgatcgtagggtgcgcgtgacgagtcctttttttggtgcgccagttgtaagtcaatctgcttgtctggatagtccaacaaattcagaaaggtaataaaatctgtctcttcactggaatgtccctatacatgtgaactgaggtcccaagtaactttgtagtggtctaatgaaaccggacacccatttaggcgagaatgctcgccagatagaggtgtctgatgaccaagcaacgtcgttccttttccgctgagttcaaacgcgaggccgcaggcctcgtgctcgatcaaggctatagccatatcgaagcctgccgttcactcggggttgtcgagtccgcgttgcgtcgctgggttaatcagcttcagcaggagcgcaccggcgttactccgcagagcaaggcgctgacgcctgaacagcaaaaaatccaggaactggaagctcgaattgctcgccttgagcgggagaaatccattttaaaaaaggctacggcgctcttgatgtcggaagaacacgagcgcacgcgctgattgatcagttgagtgcacaagagccggttgattggctttgcacagtctttgaaatcactcgttcgtgctactacgcccaccgcctcagacgtcgaactccgaacgttgaacgacttcgattacgcagtcgagtcaacgaactgttcacgcaaagtcgcagcgctgccggcagccgcagtatcgtgtcgatgatgcaggaagatggcgagcaaatcgggcggttcaaggtacgtggcttgatgcgagaactggaactagtcagcaaacaacctggctcacatgcctataaacaagcgacggtcgagcgtcctgatattccgaacaccctgaaccgggagtttgaggtatcggtacccaatcaggtctggtgtggcgacatcacctacatctgggcgcaggggaaatggcattacctggcggtcgttctagatctctacgcgcgtcgaattgtgggttgggcgctgtcgaacaagccggatgcggatctggttatcaaggcgttggacatggcttacgaacagcgtggcaggcctcaaggcctgctgttccactcggatcaggggtcgcaatatggaagccgtcagtttcgccaacggctctggcgttaccgcatgcgccagagcatgagccgccggggaaactgctgggataatgcgccgatggaacgcgtgtttcgcagcctgaaaactgaatggataccgactgagggctacatgacaacccaagaagcgcaccgggacatcagccattatttgatgcatcggtacaactggattcgaccacaccaattcaacggcggactagcgccagctcgggccgagaaaaaacttaacgtcgtgtccgggattagttgaccactacactcagacctcaccagaggtcgtctctattcccatccgaaccctaggcggctcagtgctgttttgcagcatcgggccgctgtcaggtgtttgaggcagtggtagagcgacgctagctctgcgccatatgttcgagggcgcgcagattgtctgcccacgcctgcatcagcagctttcggtctgccaacaacaaggccttgttataggtggcgcgtaccttgttgctctcgacgtgggcaagttgtcgctcgatggcgtcgggacggtaatcgttctcgttggcccatgtcgaaaaggttgtgcgccagcaatgcggtgtcgcgccatggccaaggttcatatcacgcatggcatacgtcaggcgattcggcgtcgtaaagcccttgccgctacgatgcgggaacaggtagcgtccggcgcccgaaatctgcttgatctggagaagcacctcaacagctgagtccgaaagtgggcagacatgatcccgccttgccttcatcttttcggccgggcgacgccacaggttgtccacgaagtcgaactccgcccattcagcatcggcagcttcgccagggcggcaggcggttagggcaatgagcttcaggcacagggacgtttccggatagccgcgatagccctgaagcttgtgatagaaggcttggatttgctcacgagtcattacagccttgctctggctgacgggggcgcgcagcaacccacgcaatccagggatcggattggattccgccaagccacgaaccacggcgaactcgaaaagggctgacaggtcacctttcacatgaatgcccgcccaagctccatgtgccttgcacgcttccagaatggggcggattagattcggaccaatctcgtccatgcataggccgtccagcttaggagccaagtactttttgatgcgggactcttttgtacggtaggagctggcagcaaagaccgacttgatatcggccagataggccgctgtcaccttggcgaaagtaccctcgcgctggcgcttgcgggattccgcctccgcgacattgcgctgcttgacactctggcgctcatgagaggggtgaacgccttgcttgatgagcgaacgtgccgtatcgcgtgcagcacgtgcttgggcgaggctgactttggggaaagggccgatggcgaaaaggttttccttcccttcgatacggtacttccagcgccagagcttccctccagatggtttgaccagcaaaaacaggcctcccccatctgaaagcttgtagtcgcgctcggctggtttgacggatttgatcttaatatcggtaagcagattctcgggcatctcgtgtctcccgagtggggataaaaagtacccccactcttaaacttggatacccccaaacgtacccccagcttttctggacctcagcaaacaataggaactctctgtggaccctattgtttgccctaactctatgattcaacagagttatatcgtccagggagcgctaccaagctccactgagatccggctaggacgcgtcagacgttgaagcggaagtgcatcacgtcgccgtccttgacgatgtagtccttgccttccaggcgccatttgccggcttccttggcaccggcttcacccttgaactggatgaagtcgtcgtaggcgatcacttcggcgcggatgaagcctttttcgaagtcggtgtggatcacggcggcggcctgcggggcggtggcgccgacgcgaacggtccaggcgcgtacttcctttacacccgcggtgaagtaggtctgcaggttgagcatttcgtaaccggcgcggatcacgcggttcaagcccggctcttccaggcccagggcctcgaggaacatgtctttctcttcaccgtcgtccagctcggcgatttccgcttcaatcttgttgcagaccggcaccaccatggcgccttcttcttcggcgatggccttgaccacgtccagcagcgggttgttctcgaaaccgtcttcggcgacgttggcgatgtacatcaccggcttggtggtcagcaggtggaagccgcggatcaccagcttctcctcggcgctcatgttcttcatcaggctgcgagctggcttgccttcggtgaagtgcgcgatcagttgctcgagcagggctttctgcgccacggcgtccttgtcaccgcccttggcgttgcgcgcgactttctgcagttgcttttcgcagctgtcgaggtcggcgaagatcagttccaggtcgatgatctcgatgtcgcgtttcgggtcgacgctgttggacacgtggatcacgttgtcgtcttcgaagcagcggaccacgtgggcgatggcatcggtttcgcggatgttggccaggaacttgttacccaggccttcacctttcgaggcgcccgccaccaggccggcgatgtcgacgaactccatggtggtcggcagcacgcgctcgggcaccacgatggcggccagggcgtccagacgcggatccggcatcggcacgatgccgctgttcggctcgatggtgcagaaggggaagttctcggccgcgataccggatttggtcagggcgttgaacagggtggacttgccgacgttaggcaggccgacgatgccgcagttgaatcccatggtgtttcccctcggataagagtcaggccttctggctgtgcaggtttttcatcgcacggttccattcaccggcgaagatatccggcagcacgccgagggcaaaatcgatgctggcatcgagcttttcctgttcggcgcgcggcgcacgacccaggacaaagttcgagaccatgctggcgacgcctgggtggccgatgccaagccgcaagcggtgaaaggtattctggttgcccagttgcgcgatgatgtcgcgcaacccgttgtgcccgccatgcccgccgccctgtttgagcttggcgacgccgggtggcaggtcgagttcgtcatgcgccaccaggatttcttcgggcttgatgcggaagaaaccggccaatgccgccacggcctggccgctgcggttcatgtaggtggtgggtatcagcagacgaatgtcctgaccctggtgcgaaaagcgcccggtcaggccgaaatatttgcgatcggccacaaggctgacgccttgtttctcggcgatgcgctcaacaaaaagggcccctgcgttatgccgggtctgttcgtattcggcgcctggattacccaggccaacgatcagtttgatggcagtcacgataggggcccttccttggagttgtggataacatcgccgtgactggaacgtgcggcgaaagtggacgacaagtgctcatttaccattatgtaaactccgcgttcccgcccgctttctcgctacgttccagtccgcgatgtttccggtaactccggcaagcagagtgaattactctgcagcgccttctgcagcttctggagcaacacgtggagcgtgaacgttggcaacagccaggtcgttaccgtgagccagagcaacgaactcaacgcctttaggggccttgatgttcgacaggtgaacgatggtgccgatttcagcgtcgcccaggtcgacttcgatgaactcaggcaggtctttcggcaggcaggacacttcgatttcagcgataacgtgcgaaatctcgccgcctttcttgaccggagcagcttcgttgatgaagtgcactggaacgatagcggtcagtttctgaccagcaacaacgcgtacgaagtcagcgtgcatcacgtggcctttggccgggtgacgttgcagcgccttgatcacgacgttttgcttggtgccgccaacgttcagttcgataacgtggctgaaagccgcttcgttttcgagcagtttggcaacttctttggccagcatgctgatggattcaggggctttgtcgccaccgtaaactacagctggaaccaggcttgcgagacgacgcaggcggcggctcgcacctttccccaggtcggaacgcagttcagcattcagagtaaaatcgttcatgttgtatctccaaaataaccacactcgccccagcgtttgcgaccagcgctaaaggcgatatgggcaaaaaagccccgccccaacaggaatgctggggcggggcgcttttcgtcatcgagatgtaaggctagggcagggccctagcggaacatcgcgctgatcgattcttcgttgctgatacggcgaaccgcttcggcaacaaccggtgcgatatccagttgacggatacgcgcacaggcttgtgctgcagcggacagcgggatggtgttggtcaccaccagctcgtccagcacggaattttcaatgttctcgattgctcgacccgacagtacagggtgtgtgcagtaggcaaagaccttggcagcgccatgctctttcagggccttggccgcgtggcacagggtgccggcggtatcgaccatgtcgtcaaccaggatgcaggtacggccttcaacgtcaccgatgatatgcatcacttcagagtgattggctttctcgcggcgcttgtcgatgatcccgagatccacgcccagggatttggccacggcacgtgcacgcacgacgccgccaatgtccggggagacgatcatcaggttttcgaaacgttggtcttcgatgtcatccaccagaaccggggagccgtagatgttatctactggaatatcgaagaagccctgaatctggtcagcatgcagatcaaccgtgagaacacggtcgatgccgactacggtaagcatgtcagccacgactttcgcgctgatagccacacgtgcggaacgcggacggcgatcctgacgggcataaccaaagtaaggaattacagcagtgattcgagtcgctgaggagcggcggaaggcatcagccatcacgacgagttccatcaggttatcgttggtcggagcgcaagtcggctgaataatgaagacgtctttaccgcggacattttcattgatctcagcggtaatttcgccgtcggaaaatttaccgacagagatgtcaccgagagggatatgcagctgacgtacgacacgccgagccagatcggggttagcgttccccgtaaagaccatcatcttggacacgcgcagtacctgaaggctgagggtatacctggatgagtataaggaaaatggcaggggcggctggattcgaaccaacgcatggcaggatcaaaacctgctgccttaccgcttggcgacgcccctgtatctgttgcatcaagtgcctggcacttggttccttttagagcagactttgcagcttgcgatgcaacatcgaaacattgcttccttttgctacaaaccctgtaagggtctctgtaagaagggccgagactttatcagcttcagctttgcttgggaagcccccaaacacacaacttccagttccggtcagttttgcttcggtaaatttacctagcaaattcaatgcgttacgtacatctgggtaacgccttgcaaccaccggcaaacagtcatttctgccgtttcccttgggaacggggcgcactttaatgggcggagtgtcacgtgtcaacagcggatctgaaaaaatttctgctgtacttacagagacttgcggcaccagcacgagataccaaggttcctcggggtttaccggggtgagtttttctcccacgccctcggcgaaagctgcatgcccacgcacgaaaaccggtacgtcggcgcccagggaaaggcccagcgcggccaggcgatcttcgttccagcccagttgccagaggtgattcaggcccagcagagtggtcgctgcattggaactgccgccaccgatgccgccgcccatgggcaggactttctcgatccagatatcgatgcccaacgggcatgcggattgttcctgaagctgtttggccgcgcgcacgatcaggttgctgtcgtgggggacgccggcgaactccgtatgcaggcgaatgacgccgtcatcgcgcacggcaaaggtgatttcatcgccgtaatcgagaaactgaaaaatcgtctgcagttcgtgatagccgtcttcacgacggccgaggatgtgcagcatcagattgagttttgccggggagggcagggtcagccgtggcgcgctcatgcttactgccccagcttgcgtggttgccattccttgatcaccagcgtgacgtcaaggtcgcggccatgcagcttgatccgctcgggcagccagtaaccgctctgttgtgcataactcaggtattcgacctgccagttgtcctgttcgagattggacaggcggctgtcgccgtccagggtcaggcgactcttgctgtcgggggcgggcagcccacgaacccaccaggccagatgcgagaccggcaggttccagcccagctgttcttcgagcagggcttccggggtcggggcttcgtaacgtccctggttggcgacttccagcgcgaccttgccggggcgtccggtcaggcgggcggcgccgcgacccagcgggccggacaggcggatatcgtagtaatcctggcgctgcagccagaacagcgtgccgctgcccgaatccttgggggcgcgaatgccgatcttgccgttgatctgccagccgtcgaggccgctcagttgctgtttgtgctcgcgccatagcgcggggctgccgtgaccctcgacggattcgcgggtgccgaaacccgagcagccggcgagcagggcgataaagctgaaaacgataaggtggcgcaaaaacatagtcttaaagggtctctgatccggtcaggcgcttgatggtgctgcgcaggatagggctgtcgggctggtccttgaggaacttgctccagatctgcttggcttcgcgttgcttgccattggcccagagcacttcgcccaggtgcgcggcgacttcctggtcgggaaagcgctccagcgcctggcgcagcaggcgttcggcttccgcgaggttgcccaggcgatagttcacccagcccaggctgtcgagtaccgccggatcgtccggggtcagctggtgggcctgttcgatcagggccttggcttcggcgtagcgggtcgtgcgatccgacagggtgtagccgagggcgttcaatgccatggcgttgtccggctcgcgcttgatgatcaggcgcaggtccttttccatctgggccaggtcgttgcgcttctcggcctgcatcgcacgggtgtagagcaggttcacatcgtccgggtattgctgcagggcttgctggagaatcttccaggccttgtcgccctgtttgttggcggacagggtttcggcttcgatcaggtacagctggatggcgtagtccggctgggtgtcgcgggcggcggccaggcgtttttcggcttcggcggtacggccgttgttcatcaggatgtcggcctggcgcaattgtgccggcaggtagtcggtacctgggccgacctggccgtattccgccagcgcgccttgcgggtcgttgagctcttcggcgatgcggcccaggttcaggtgcgccgaatcgacgtggctttcccgggcgatcaggtcttccaggtaacccttggcctcttcccagtccttggcttccaggcagaccagcgccagggagtaacgcagctcgtcgtcttccggatactgctggaccaggctggagaactgggccttggcgtcgtccatgcgatcctgctcgaccagcatgcgcgcgtaagtcaggcgcaggcgcttgtcgtccgggtatttgcgaatgcttttttccagcagcggcagggcttcgtcggcgcggctgaggctttgcagcaggcgggcgcgcaggaggatcggcgcgatctcgccttcttccggcgggttctgctccagcagtttcagggcttcgcgggtatcgccgtcctgttgcagcagcagcgccttgccgaacaccagttggccgttgttcgggtgtttttgcagcaggcggtcgaaactcttcatcagaccgttgcgggtgtcctggtcggtgtcggcggccgacagcgcgaggaaatcgaaatgggtatcgcccttgccctgcaggactttttccatatagaccatggattcgtcgtaacgcccggtgcgggccaactggatggcggcggcacgctgggcttccaggtcgtccggggcgtttttcgcccaaatcagcgcagtgtccagcgcggcctggtcggcgcccaggtattcggcgatgcgaaacgcccgctcggagatgcccgggtcctgggtattgatggcctgggtgacatagttgtccagggcaatgtcgaaacgattgcgttggccagccagttccgcgctcagcaggctgaagaccgtgtcttcgctgaacgaggagtaaaccttgggcttttcaggagccggggtactgtcttcgaccggcggcgtaccgtccggtgaaacgggtgccaaggcctggcagccgctgaggaagacaaaagcgaggagcaacgcggaagatctattcatataggaagaggacgactaacctgcggtcggatcatcatgacacaagccttcggccaaacataaccgagactcagtggatgccttacagaggcagtctattgggacaatagtcggcagtggttgttctgaatctttcgaagtaggacaattgtcggcttctcgacatcatcagcgaccttgaatggccttcctcgcactcggtattaaccacaagactgcttcagtagacgtccgcgagcgcgtggcctttacccctgagcagttggttgaggccttgcagcagctctgccgcctcaccgacagccgcgaagctgcgatcctctccacctgcaatcgcagtgaactctatatagaacaggatcacctttcggcggatgtcgtgctgcgctggctggccgagtatcaccatctgagcctcgaagacctgcgcgccagtgcctatgtgcacgaagacgatgcggccgttcgtcacatgatgcgtgtcgcctcggggctggactcgctggtgctgggcgaaccgcagatcctcgggcagatgaagtccgcctacgctgtggcgcgtgaggccggaaccattggtccgctgctggggcggctgttccaggccaccttcagcgccgccaagcaggtacgtaccgacaccgccatcggcgaaaacccggtttccgtggcctttgccgcggtgagcctggcgaaacagattttcagcgatctgcagcgcagccaggcgctgctgatcggcgccggcgagaccattaccctggtcgcccgccacctgcatgacctgggggtcaagcgcatcgtggtcgccaaccgcacgctggagcgcgccagcaccctggccgaacagtttggagcccatgccgtgctgctgtcggatattcctcaggagctggtgcacagcgatatcgtcatcagttccaccgccagccagttgccgatccttggcaagggcgcggtggaaagcgcgctgaagctgcgcaagcacaagccgatcttcatggtggatattgccgtgccgcgggatatcgagccggaagtcggcgagttggacgacgtttacctctataccgtcgacgatctccacgaagtggtcgccgaaaacctcaagagccgccaaggcgcggcgcaggcggcggaagagctggtgaacatcggtgccgaggacttcatggtgcgcctgcgcgagctggctgcggtggacgtgctcaaggcgtatcgtcagcagagcgagcgcctgcgcgatgaagaactgcaaaaggccctgcgcatgctgagcaacggcagcagcgccgaagacgtcctgatgcaactggctcgcggcctgaccaacaaactgctgcatgcgcccagcgtccagttgaaaaaactgaccgctgaaggccgcctggatgcgctggccatggcccaggaactctttgccctcggtgagggcgcttcggactcttcggataaaaaaccgcaatgaaagcgtcactgctcaataagctggatgtcctccaggaccgtttcgaagaactgaccgcgttgcttggcgacggcgaagtcatttccgatcaggccaagttccgcgcctattccaaggagtacgccgaagtcgagccgatcgtcgagacctataaacaggtgctcaaggtccaggccgacctcgagggcgcccaggcgctgctcaaggacagcgatccggacatgcgggaaatggcggtggaagaagtccgcgaggccaaggaacaactggtcgagctggaaagcaccctacaacgcatgctgctgcccaaggaccccaacgacgggcgcaacgtgttcctggaaatccgcgccggcaccggtggcgacgaggcggcgatcttctccggcgacttgttccgcatgtattcgcgttatgccgagcggcgtggctggcggctggagatcctctcggaaaacgagggcgagcacggcggctataaagaagtcatcgcccgggtcgaaggcgagaacgtctacggcaagctgaaatttgaatccggcgcccaccgcgtgcagcgggtgccggccaccgagtcccagggccgcatccatacttcggcctgcaccgtggcggtattgcccgagccggacgaacaggaagccatcgagatcaaccctgcggacctgcggatcgatacctaccgctcctccggtgccggtggccagcacgtcaacaagaccgactcggcgatccgcatcacccacatcccgtcgggaatcgtggtcgagtgccaggaagaacgttcccagcacaagaaccgggcgcgggccatgtcctggctgtcggccaagctcaacgaccagcagaccagcgccgcggccaacgcggttgccagcgaacgcaagctgctggtggggtcgggcgaccgctccgagcgcattcgcacctacaactttccccagggccgggtgaccgatcaccgcgtcaacctgaccctctattccctcgatgaaatcctcgccggtggcgtcgaggccgtgatcgaaccgcttctggccgaataccaggccgatcaacttgcggcactgggcgagtaaacataaatgaccatcatcgccagcctgttgcgcgccgcccaattgcccgattcgcccacggcccgcctggatgccgagttgctgctggccgctgccctgggcaagccgcgcagcttcctgcatacctggcccgagcggatcgtgcccagcgaagcggcgctgaccttctccagttacctgcagcggcgccgttccggcgaaccggtggcttatatccttggccagcagggcttctggaagctcgacctggaagtggcgccacacaccctgattccgcgtcccgacaccgaattgctggtggaggcggcgctggagctgctgcccgccaccccggccaaggtgctcgacctgggcaccggcagcggcgccatcgccctggccctggccagcgagcgcccggcgtggcgggtcaccgcggtcgaccgggtgctggaagccgtggccctggccgaacgcaaccgccagcgcctgcaactggacaacgtcacggtactgagcagccattggttcagcgccctgcaaggcgagcgttatcaactgatcatcagcaacccgccctatatcgccgacaccgacccgcacctggcggccggcgatgtgcgtttcgagccggagagcgccctggtcgcgggcaaggacgggctggacgacctgcgcctgatcatcgcccaggcgccagagcatctcgaggctggcggctggttgatgctcgagcatggctacgaccaggcgccggccgtacgcgacctgttactcagccaagggtttgccgaggtgcacagccgtgtcgacctgggcggtcatgaacgtatcagcctgggacgcctgccgtgctgaacgatcaagagttgttgcgctacagccggcagattctgttgcagcacgtcgacatcgacggccagttgcgactcaaggccagccgcgtattgatcgtcggcctgggtggcctgggtgctccggcggccttgtacctggccgccgcgggcgtcggcgaactgcacctggccgacttcgatacggtcgacctgaccaacctgcaacgccagatcattcacgacaccgacagcgtcggcctgagcaaggtcgattcggcgatggggcgtctgtccgcgatcaatcccgaaatccagctggtgccccatcgtgccgcgctggatgccgactccctggcggccgcggtcatggcggtggacctggtgctcgattgcaccgataacttctcgacccgcgaggcagtgaatgccgcctgtgtcgccgccggcaagccgctggtcagcggcgcggcgattcgcctggaagggcaactgtcggtgttcgacccacggcgtcccgagagcccgtgctaccactgtttatatgggcatggcagcgaagcagaactgacctgcagcgaggccggtgtgctcgggccgctggtggggctggtgggcagcctgcaggccctcgaggccttgaagctgctggtggggttcggcgagccgctggtgggccgcctgttgttgatcgatgccttgggcacgcgttttcgcgaactgcgggtcaagcgcgacccgggctgcagcgtctgtggaggccagcatgcgtgaagcgccgatcggcgtcttcgactccggcgtcggcggcctgtcggtgctggcggagatccagcagcgcctgccccatgaatcgctgctgtatgtggccgattgcggcaacattccctatggcgagaaaacccccgaattcatccgtcagcgttgcagcctggtcgccgggtttttccgcgagcagggcgccaaggcgctggtgctggcctgcaacaccgcgaccgtggccgctgtcgccgacctgcgtcgggactacccggactggcctatcatcggcatggagcccgcggtcaagccggctgccgccgccacccgtagtggcgtggtcggcgtgctggccaccaccggcaccttgcagagtgccaaattcgctgccttgctcgatcgtttcgccatcgatatcaaggtcatcacccggccatgtccgggcctggtggaacggatcgaagccggggacctgcacagccccacgttgcgccaactgctgcagggttatgtcgaaccgctgctggcggccggctgtgacaccctcatcctcggctgcacccactatccgtttctcaagccgttgctcaagtcgatgatccccgaggacatcagcctgatcgataccggggccgcggttgcccgccagctggagcgcctgctcggcgagcgcgagctgttggctgcggggcccgcacgccaggcccggttctggaccagtggcgatccgtgtcacttcagacatattctgccgttgctctggaaagaggcgggagcggtgcaaagcttcgctttataaaaaatcctgcagaagtgctgatttgcgctgaacttctgttcaagcacagatttctattaacgtgtctgcggaatctgtacaacaccatgcaaatcgtttgaaaaggatgttcctgatgagacgaatgttttgtttggctgcacttgcagctgcgctattggggcaaagtttttcggcacaggcggccggcgtcgagttttcggtggggcagaccggcgattcgacccagacctatcgcctgggcatgcaattcgattgggacaagagctggctgcaaagcgatgtcggtcgcctgaccggctactggagcggcgcctataccttctgggatggcgacgagaagtccagcaaccacagcctgtcgttctcgccggtgctggtgtacgaatttgccgggcagaacatcaagccttacatcgaggcggggatcggcgtggcggtattcgccaacaccgaggtggaggacaacaagctcggttcggcgttccagttcgaggaccgcttcggtttcggcctgcggttcaacggcgggcatgaagtcggtctccgtgccacgcactattccaacgctggcatcgcgacgcccaacgacggtgtagagagctactcgctgcattacaccatgccgttgtaagaccctttcagcgatacgccgtggcgatgccgcggcgttcgttgaggcagtccacttcccccatctcgaactcccggcagatcagtggccgttgttcgtagatgctgcacagcatgctgttgcgatccagcgcggcacaccaaccatcatccagtcgcaacatgacttcgccgccccactcgtcggtgtcgataaaacgttcgggcaccccggtttcggtgatcagcatcacttccagttggcagcagcaggctgcgcagctcgagcaggtgaccgccgtttcggcgatctgggtgacaggaatagtggtcataggcgcgcagtgtaaggcagtggccgcaggctgtgtgaaaccactgacggacgcctgccgcccttactcccgatactcctcggccgccacccgtgacggcaggttcttgaaggccgccaaagcgcgctcgcgggacatcgacagatcgaccatcggcggcgggtaatcggccacgccgaacaggccgcccatggcggccggattgtggatatcttttgcattcaaccccgccagctctggcagccagtgcttgatgaaagccccttggctgtcgaacctctgcgactggctcaaggggttgaagatgcggaagtagggcgccgaatcggtgccggtggatgaactccattgccagccaccgttatttgccgccagatcgccgtcgatcaggtggcgcatgaaaaagcgctcgccctggcgccagtcgatcagcaggttcttggtcaggaacatcgccacgatcatccgcaaacggttgtgcatccagccagtttccagcaactggcgcatggctgcatcgatgatcggcaggccggtgcgggcctgctgccaggccgccagctcatcgggggcatcgcgccaggccacggcttcggtttccgggcggaaggcccggtgccgggatacccgcggataacccaccaggatgtgtttgtagaactcgcgccagagcagttcgttgatccaggtgacggcgccggggctgccgctggcgaactcgccccggttgttctgcagcgccgcgtgcaggcattggcgtggcgacagcacgccggcggcgaggtagggcgaaagctgactggtgccgggcctggccggcaagtcgcgctcggcctggtagtggtcgagctgggcctcggcaaaatgcgccaggcgttgttgcgccgcggtttcaccggccggccagagtgcctgcaggtgcgggtcgggtgtcgggaagccctcaacctgccggggcagcgcatcggcctttatcctcagcgcggcttgcgccctgggagccgccagctgtggcggcagggcgctgtgcagccggttgtagcagaccttgcgaaactggctgaagacctggaagtagccgccgctcctggtcagcacgctgccgggccggaacagcagttggtcgaggtaactgtggaagcccacgccctggctcttcagcaggctggccaccgccgtatcgcggcgactttcgtggatgccgtattcctcgttgacgtgcagcgcctcgatggccagttcccggcacagctgcaatagcacctggggtgcctgctcccagcttggcgcttggcggatcagcagtgggatattcagccgcgccaggtcgccactcagttgttcaaggttacgcagccagaagtcgaccttgcacggtgcatcgtcatgcgcctgccactgccgcgggctcagcaggtacagggccacagtcggcccgcgctgggtcgcggcgctcagcgcggtgttgtcatgcaggcgcaggtcgctgcgtagccagatcagttgcatgggaattcctgcattagagaagccttagcccggtcagggcctggtgcgccgagagcgggtctgcggcgaggtgcagattggcgatctcggtagtgcagatggccagttcggcgtggtggatgctcactgctgggccgacgatgagtaccgggcagtcgaggccgccgagcaggcgtggcagttgccgcaggttgatcgactggctcgagtacaacagcacgcctcgcgctttcaggtgttcggcggccagggccagttcaccggggggcagcggccagtcgaagacttccacggggcagtcggcattgctgatcagccaggcgcagagccacaggtgtggctccagcggcaggtccgagtgattgatcagcagcagcggggcgccttgtagctggcgattgttgtgatagacccgcaccgcgaatttgctgcgcagccaggaatggaaaaacacccgctccatccgcatgccgaagcggccctgccagcgctgttcgagttcgcccagcagcggtagcagcaggtgctcgcacaaggttcgtggcggatagagcgccatggcctggttgaagctttcgtcgacctgacgctcggccagttggctgatggcctggatcaggcgctggcgttgcaggtgccagtcgttttgggccggttcgctgggcgccggctcggcgtccagcaggtgcttgacctggctgaccgccaccccgcgattgagccaggtcaggatcttcaggatgcgctgtacgtgttcgttggaaaacagccggtgacccttggcggtgcgttgcggcacgatcagcccgtaacggcgttcccaggcgcgcagggtgacggcgttgaccccggtctggcgggtcacctcgcgaatcggcagccagccttgctcatgggcgccatcggattcgctggcggatgcatccgggtcgagcctcgaatcgttcatggttcagagcgcgttgcgcaggctgaggctttccgggtggggctgcaggtacacctgttgcgcgatgtagggatcgggatgtcggcgcaggtgatgcttgagcagggtcagcggtaccaccagcggcacgatgccgtggcggtactgggtgatgaggtgctgcatttcctgtttgtcgtcgcaactgatggcttgcttgagatagccgctgatgtgttgcagcacgttgctgtgggtacggcgggtggcgcactttttcagggccgccatcaactggctgaaataacgcgggccgacgtgcgccgggtcgctttggcccatgctgcccagcagggtgccgagggccttgtattgctccgggttgtgggccatcagcaggtatttgtagcgcgcgtgaaaatcggtcaggcggcgacggctcaggccttgcctgagcacgtcctgccaggcgctgtaggcgaatacccgggtcaggaagttttcccgcagcaccggatcgttaagtcggccgtcttcttccaccggcaggtccggatggcggctgcagaaagcctgggcatggataccacgtccgctgagctcggcggggtggccctggtcctggtagaccttgacccgctccaggccgcaggacggagatttctgcatgaagatgtagccgcagaggctgtccagttcagtggccatgcgctggccgtaatcggtgagtgcccgggtgacatccatggtttggtcgacgctgccaacggcccgcggttgccgcggatcgcccatcaggcggatcggttcgcggggtgtacccaggccaatggcgacttccgggcacagcgggacaaactcgaaaaactcagcgaggacctggctgcacaggcgcgattccttatgcccgccgttgtagcgcacatgcgctcccagaaggcaggcgctgatggcgattctcggcttgtcggcctgggctggattgtcgggcatgtgagaggctccgggtttcatgtacaaaaataagatcttgtacaactttgcttcatcataggatcaaaggtgtgcaagtcaaatattttgtacaggtttgcgccgcggagcctttcgggtcatttcctgatcatctggcggtcgctgggccatccccgttcgattgctggctggctaacgcatgagattgttggcgcgcgtttttcttcgtctcggaacggtccgatcggcagaagtgtgttcgagtcttgagcggaggagacaggctgctgtccattgcgacagcagcaaaacgttatgcggggggatgcgcttacaggttttcgtgcaaccggcgggcggcctcctgcccgctgagccaggctccttcgacgcgaccggacaggcaccagtcgccgcacacatagagccccaggtcgacatccgccagggctccccactcatggctgctcgctgggcgagcgtagagccagcggtgggcgaggctgaaggtcggcgcaggcatggcgctgtgcagcagttcggcgaaagcgccgtgcaactgctcgatcaccgcctctttcggcaggtcgatgtgctggcggctccaggtgctgctggcatgcaggacccaggtgtcgaggctgttgtcgcgccctggcttgctgcggttacgggccagccagtccagcgggctgtcctgtacgaagcagccttccaccggggtttccagcgcggtctcgaatgccagggcgacggcccaggtcgggtccattttcaccccggcggcggcactcgccagtttcggtgcggcggccagcagggcggtggcctggggggccggcgtggcgatgatcacgtggctgaacgggccgtgggtgaaaccttcggcatcctgcaggtgccaatgctgctcgccgcggtagacctcggtgatgcggcaggcgaaatgcacctccgtttcgcccagcaggccacgggtaatggcactcatgcgcggggtgccgacccagcgggtctgttcgtccggcgacggggtgagctggccgccatggaagttgtacagctgcggcgtccattcggcggcccagccattggcttgccagcgctggacttcggtgacgaagcgccggtcgcgagcggtgaaatattgcgcgcccatgtccagcgcgccggcgtcgctgcgcttgctggacatacgtccgccgctgccgcggctcttgtcgaagagttgcacgacatgcccggcgtctctcagcgcctgggtggcggagagtccggcgatgccggtaccaatgattgcgatgggtacggtcataggggcctcgtttacctttctgtgcagactacgccgtcgttaaaatctgtacaattttgttttttggtataactttcggcgttatcggttttacagggtgtcctattgttaaacacagagcctgcccgattgaaaagatccctgcttataaaaatagactagtgatccgggtaaaacgccacgcgaggaagatgtcatgcacatattgctgaccggcggtactggtttgataggacgtcagctctgccgtcactggctgacccagggccatcagttgaccgtatggagtcgtcggcccaccgaggtgcccaaactctgtggcgctcaggttcgcggcatcgcccgcctggacgaacttgcagaggaaccggtcgatgccatcatcaatctggcgggagcaccgatcgccgatcggccctggactcacaagcgcaaggcgttgctctggagcagccgcattaccctgacggaaaagttgttggcctggctggaaagccggaggcagaaacccgggttgctgatctccgggtcggccgtgggctggtatggcgatggcggagagcgcgagctgaacgaggattcgcccccggtcagtgaggattttgccagccagttgtgcatcgcctgggaggagaccgcgcagcgtgccgaggccatgggcctgcgtgtggtgctgattcgtacgggcctggtgctggcggccgagggcggctttttgtcgcgcttgctgctgcccttcaaactggccctgggcgggccgatcggtaacggtcggcagtggatgccgtggattcatatcaaggatcaaatcgccctgattgattttcttctgcaccgcagtgatgccagcggtccttataatgcctgcgcgccgaagccggtgcgcaatcgcgagttcgccaagaccctgggcagcgtcttgcaccggccggcggtagtgccggtgccggcctttgtcttgcgtgtcggcctgggggaattgtcgttgctgctgctgggtggtcagcgcgcggtccccgcgcggttgctggccgccggattcactttccagttcactgatttgcgcgcggccctggacgacttgtccagccgcctctgaaataggacgttgcatgaccgatcacgcgttgctcctggtcaacctgggttcgccggcctccacctcggtggcggatgtgcgcagctacctcaatcaattcctgatggacccttacgtgatcgatctgccgtggccggttcggcggttgctggtatcgctgatcctgatcaagcgtccggagcaatcggcccatgcctacgcttcgatctggtgggagcagggttcgccgctggtggtgctcagccgccgcttgcaggaagccatgacgagtgagtggaagcacggcccggtggaactggcgatgcgttatggcgagccgtccatcgaatcggcgctgctgcgcctggtggcccaggggcagaagaagatcaccctggcgccgctctatccacaattcgccgacagcaccgtgaccacggtggtggaggaagcccggcgggtgattcgggacaagaagctggatgtgcagctttcggtgctgcagccgttttacgatcagccggagtacctcgacgcgctggtggccagtgccaggccgcacctgcaacaggacttcgatcatctgctgctgagtttccatggcttgcccgagcggcacctgaaaaagctcaatcccggtcatagcctggaaggtgattgctgccgcgacgcgacccccgaggtggccgccacctgttaccgcggccagtgcctgagcacggcccgggcattcgccgagcgcatggggctggcggacggcaagtggtcggtgtcgttccagtcccgtctggggcgtgccaaatggatcgagccctacaccgaggcgcgcctggatgaattggcccgacagggcgtgaagaagatcctggtgatgtgcccggcgtttgtcgccgactgcatcgagaccctggaagagatcggtgatcgcggtcgcgaacagttccgcgaagcgggaggggaggagttggtgctggtgctggtgccgtgcctgaacgacgacccgcaatgggccaaggcattgaacaccttgtgcgagcgtgcgcctttggcgttgtaaacgcatcgcgggcaagcctcgctcctacggcaataccgtctgtaggagcgaggcttgcccgcgatggatttccggctgacgcggatcctcagatcagcggctcctcagccttcttgttcttccagccgtcgttgcccggcaggatcaggttcagcgcaatcgcgacgacggcgcacagggcgatccctttcagaccgaagtcgtccggaccggtcccggtaccgatcagtaccccgccaatgccgaacaccagggtcaccgagacgatcaccagattgcgggcttcgcccaggtcgatcttgtgacggatcagggtgttcatgcccaccgccgcgatcgaaccgaacaacaggcagagaatcccgcccatcaccggtaccggaatgctttgcagcagcgcaccgaacttgccgataaacgccaggctgatggcgaagatcgccgcccaggtcatgattttcgggttgtagttcttggtcagcatgaccgcgccagtcacttcggcgtaggtggtattgggcgggccgccgaacaggccggcggcggtggtggcgatgccgtcaccgaacagggtgcgatgcaggcccggcttcttcaggtagtcgcgaccggtcacgctgccgaccgcgatcactccgccgatgtgctcgatggcaggtgccagggccacggggacgatgaacaggatcgcctgccagttgaactccggcgcggtgaagtgcggcagggccagccagggggccgcggcgatcttcgcggtatcgaccacgccgaagtagaacgacagggcaaagcccaccagcaccccggagatgatcggcaccaggcggaagatgcctttgccgaacaccgcgacgatcagggtggtcagcagcgccggcatcgagatcatcatcgccgtctggtaatgaatcagctcgctgccgtcgccggccttgcccatcgccatgttggcggcgatcggggccatggccaggccgatggaaatgatcaccgggccgatcaccactggcggcagcagccgatcgatgaaaccggtgcccttgatcttcaccgccaggcccaggaaggtataaacgaaaccggccgccatcacgccgcccatggtcgcggccaggccgaactggcccttggcgagaatgatcggggtgatgaaggcaaagctggaggccaggaataccggtacctggcgcccggtcacgagctggaacaacagagtcccgagacccgccgtgaacagcgccacgttggggtcgagaccggtaatcagcggcatcaacaccaacgcgccaaaggccacgaagagcatctgcgcgccagacagcacttggcgccagagcggatcgttgaactcatcccgcatgctcaggcgtccttctgcttggtgccgaagatcttgtcgccggcatcgcccaggcccgggatgatgtagccgtgctcgttgagtttctgatcgatggaagcggtgtagatggtcacgtccggatgcgctttctcgacggcttcgatgccttcgggagcggcgaccagcaccatggcgcggatgtccttgcagccagcctttttcagcaggtcgatggtcgcgaccatggagctgccggtggcgagcatcgggtcgatgatcatggccaggcgttcgtcgatttccggaaccagtttttccaggtaggtgtgcgcctgcagggtttcctcgttgcgggccacgcccacggcgctgaccttggcgcccgggatcaggctgagcacgccttcgagcatgccgataccggcgcgcaggatcggcaccacggtaatcttcttgccggcgatcttctcgacctggacggggccgcaccagcccggaatctcataggattcgagcggcaagtctttggtggcttcgtacgtcagcagggcaccgacttcctgagcgagctcgcggaagttcttcgtgctaatgtcggcgcggcgcataaggccaagtttgtgtcggatcagcggatggcggatctcacggatgggcatagggaaaggctccggcggcgggcaaaaaaaccggcctagattaatctatccgagggtgttgtcctatagacatctaagtacgttagtccagaaacgcttgatctgaccgggccggatgcgtacctttgctcgcttttccgaaactgccaccccccccttggagagcgccatgtccgctgatctcgagcatatccgtcaaatcatgcgcgaggctgactgcctgtacaccgaagctgaggtcgaggcggccatcgcccgagtcggtgcacaaatcaatgaacaactggcggagcgcaatccggtggttttctgcgtgatgaacggtggcctgatcttctccggcaagctgctgacccacctgaaattcccgctggaagcttcctacctgcacgccacccgctatcgcaacgaaaccagcggcggcgagctgttctggaagtccaagccggaagtgtccttcatcgaccgtgacgtgctgatcatcgacgacatcctcgacgagggtcataccctgggcgcgatcatcgacttctgcaaacacgccggtgcccgcgcggtgcacaccgccgtgctgatcgacaaggaccacgaccgcaaggcccgtcccgacctgaaagccgactacgtcggcctgccctgcgtggaccgctacatcttcggttacggcatggactacaagggttactggcgcaacgctgccggcatctttgccgtcaaggggatgtaagccatgagcgagccgagctatctggatcagtcgctgtttgccgagctggccgaaaaagcctcggccagcccccgtggtcgccatcaccacaatttccatcagatgcaagagccttgtcaccgcatggcggtggggctgcagccatccacctatatcccgccccatcgtcatctaggtgacgacaaggccgagaccctgctggtgctcaagggggccctgggcctgctgattttcgacgacgccggtcaggtgctggaaaaacgtgtgctgcaggcgggtggcgattgcatgggcgtcgacctgccggtcggcgtctaccacggcctggtggtgcttgagcccgatagcttgatgttcgaatgcaaggccgggccttatcgtccggtcggcgaaggtgaactggccgcttgggcgccccgcgaaggcgagccgggtgtggccgaataccaggcctggatgcgcgcccagttcgactgagcgccatccttgcgctggagctgtagccgcgcctgcaaaaatctgcgctgacccatgctagagtgccaggccttgtgtccggagcctgtcatgagccttttgattcgcagttgcgcggcctttgttctgatcctgagcctgcccctggccgctgccccggcgcccatgcacgcgcagttcctgccccccgatgacctgaccctgcgtgacgtcgctcccgagcagcaacagttgttgcaggtcaccgaatactcggtggtcatcggcagccagcgccaatccaaccagcaaccgatcccggtcacttcgccgctgctggtccggctcaagggcaagccgttgaacaagggcgcgaccatcagccaggtgctggtgaatttcgacggcgagagcaaaagcctgaaaaagccccagttcgacgccaagagcaagaccctcaccctgttctatccattggcccagtatcgggtggtgatggacctgttgcgcaacgatacggtgtattgccagttcctcagctacgccaacggccacatctgggccgatctgcacaccggcgccgtacgctcgcgttgaggcccgacgcggcctgggggtaaactgcctgccccgtgaaatgtctgcgagctggagtcggcaatgcgtaaagataagaaacaagtgattggtgacgagatcggcgatgcgcagatcaaactgttcctcgatttcgagccggccgacgccacttcgccgtccctgcacaagctgatcaaggcctatcgtggcctgcgtatcgacgatttcgagcgtttcctggtgttcttcgtcgaggccggctacgacctggacggcaaggacgagcacggcaaggatttcgtggccctgatccaggaccagcgcaatgccgccgactacatcgaactgatcgaaaaagcccgcggctgaaaactcaccgccccggttgtggctgtgtgtaagcggccataaaaaaacgccccgctctctcttggagaacggggcgtttttcgtgagcgcggcttaagcgtagctttcggcttcgctgctctgctcgaccagctccaggctgacgttgttctcgctgttgatcttgcggtacagcgtggcgtcggtttccagggccttttcacgggccgggaagatttccttgagcttgctggcccactcgccgctggccttggccgggaagcagcgctcgatcagttccagcatgatcgagacggtcaccgaagcgcctggcgaagcaccgagcagggcggcgagggagccgtccttggccgcgaccagctcggtaccaaactgcagcacgccgcctttcttcggatccttcttgatgatctgcacccgctggccggccacttccaggcgccagtcttcggccttggcctccgggtagaagcggcgcagggattccaggcgctgctccatggactgcatcacttcgctgaccaggtacttggtcaggtccatgttgttcttggccacggccagcatcgggccgatgttgccggcgcgaaccgacatcggcaggtccatgaacgaaccgtgcttgaggaacttggtggtgaagccggcgtatggcccgaacagcagggacttcttgccatcgaccacgcgggtgtccaggtgcggtacggacatcggtggcgaaccgaccgcggcctggctgtagaccttggcctggtgatgcttgaccacttccgggttatcgcaacgcagccactggccgctgatcgggaagccgccgaagcctttgctttcctcgatgcccgaggcctgcagcagcggcagtgccgcgccaccagcgccgaggaacacaaacttggcgtcgacttcacgggtgttgccgctgttgacgtccttgatgctgacggtccagccgttgtccttgttgcgtttcaggccggtgacgcgcttgcagtacttgacctgggcatcgggtgcgctggtcaggtgcttgagcaactggttggtcagggcgccgaagttgacgtcggtgccgttgatcacgcgggtggcggcgaggacttcgtcagccgcgcgtcccggcatcatcagcggcatccactcggccatcttggccttgtcttcggtgtattccatgtccgcgaaagcgtggtgcttgctcagcacttcaaagcgcttcttcaggaaggacacaccgctgtcgccctggacgaagctcaggtgcggcaccgggctgataaaggacttggacgagccgaaggtgcctttcttggtcaggtaggaccagaactgcttcgacacctcgaactgggtgttgatatgcacggctttcttgatatcgacggaaccgtcggcggcctgtggcgtgtagttcagctcacagaggccggcgtggccggtaccggcgttgttccacgggttggagctttccgcggcacccgaatccatcaactcgacgacttccagcttgatcgcggggtcgagctccttgagcagtacagcgagggtggcactcatgatgccggccccaaccaatacgacgtctactgcttcgttatgcgccattaacgcgtctccaaaatctgcagcaccaaattgacggcatagctgccaggagtaaggggcggttcacgttatgccccgggtcactcatggccaggatcgccatgtccgaatcttcgcaatttttcgcaacttcgacggacgctaccaaccgggcctgatccgcgtatgaacgcatttcagggcagggcgggcaattcgacttatggtcaagagtccgtttgtgcaaccaaatccgtagcggacaggcttcaagcgcaagtatctgaggcgtgctcggtcctgtgtaatcgggctgttgtagacgctaatggtgccagtacagacgcaaaactattcatttgctcgccacactcttgtgaagttgtgaaaacccgttttttcacgctcttttgaagacgtgaacctcaaaaaagggctgtccaagcctggcaccggcccgaggggtgaatgccgacatggagcacgtggcattaacgggcgaacagcttagtggccgagcaatggcagctctgcagatgcgcgaaaagcggtggtttgcaagatgaacagcaagcacgccggcttcactcgatctgtgtgggcggctctctgtgggcaatgcgggggagctgaagctgatgcatcagcgatgctgcgaggcccgatcaggagacgtccttataatcggggggagattgtaacgaagaaacgcgcagaaatgatcctgtttaatgacttttattaggcttttggtcaggtagccatcatcggttgcacccgggcgcgggcaatgcgtgggctgacgcgggcgctggcgggtagcggctggtgcaaccagttgagacggatttcctcgatttccacccagccgtcgcccattggcggcactttgcagtgcttgaaagcctggcagcggccctgcgggtcgagcttggcgaagctgcggtatttctggcgcggagcgaacaaggaccagaggaaatgcatggcgatgtacctgttgggcagttgcgatgaagaatgccgcccgggcgttacatggccatgtaacgctcgtgacggggaggttacagcaagcgcctggtaccgaacctgtatgagagctgactgactcgcgccgggccgctggttagcggccgctgacccccgctatactgcgcgcctgtctgtgcctgatttctggagaaatgagcatgttgcaacgcctgttgttcggtttgatcactgtgaccagtttgacgctggctggttgcgcccatagcccgcaacaactcagcccggaaccgaaactcaccactcagctcgcgccggtcggccatggccagccggtggtcgtgaaagtggtcgatggccgtccgtcgccaaccctgggtacccgtggcgggttgtaccctgaaaccagcgcgattaccgtccagggcgcgcagatcctgccgaagctgcaggcccaggccgaagccgcggtacgcctgctgggctttaccccgactgccaacgcgctgaacgctccgcaactgaccgtgaccctggccgagctgaagtatcagtcgcctaaggaaggcctgtacgtgaccgaggccaccatcggcgcgaccttccgttccgatgtgcagaacgccaaccgccgctacagcggtcgctacggtgcgtccctggaccagcgtttcggcatggcgccgaaccaggaaaccaataccaagctggtcagcgatgtactcagcgacgccttgacccgtctgttcaaggacccgagcatcggccagattctcggcgaataatggtagccgctgccggaggctcgggccgcgttcggacgataaggcccgaagggccttgcttgacggcttcggcgctgtacacaaaaaagcccggcttccacagaagccgggctttttattggctgtcgatttgtttcgagtccggcctcacgccgcctcgacgtaaaaatccagcacgctgacgcctgtcagcaggtcggtttccggcaggtcggcatgctggtgcccgccgagggcgcaatacaccagccagtggcggtcctggacgttgaaggccagggctccgaccaaggcttcctgttcgtcgctgggggcgatcaggtagaggcggtcctggttttctgcgtgcagcatgacaagctccgtgtcggtttcgaggggcgccagactggcctgtttgtatgacgaacgtatgacagggcgaattaaccggcaggcggcttgttatctgtcggaaagcccaggcagaaagtgagcctttgggtaaaatccgcgccgcgagtcgccagggctcgttatccggtttcattcgaggttcgtgatgtcgctgcaactgatctggtcgctgttcagcgcccaccccgccaagctgatcaatattcttgccttgctgttcgcctttcccggtagctggttgctgcacgccacccgacgccgtgagcagcgtgcgctggccaatctggccgcccagggccaatcccgctcccaggatctgccggcgcaggcgttggacgacgcgaccttgcgcatgaaccggttcttctaccgcttcggttttgcctgcctggggctggcgttgctggtgtcctggatcagcacccggttctgaaagccgaggtcgctcgcgcgagcggcagcgtttcccggcacacattgcacaaacgacaacggcgccttctggcgcccttgtcgtgtgcggtgagcgttatggcaatgccagtcccgccttgacccgatactgattgcgcaccggcgtcgcatactgcagcaccaggtacgggcgatgttcctccgggcaggcatccaggcgccgttgccactcttcctgggccttggccagttcgtccgccgggaacacctgggccgcgctcggtacctgcagcgccgggtcggcatcgctccactgggcgtaggccaggtaatgcaccgggaacaggcgataaccgccgagaatctgccggtccatctccaccgccaattgcttggtgtcctcgaacaactcgctgatcggcgcggcgaagttcacgtggacccggcccttatagccggtgatgcccttggcgatgctgatgtcgtcctcgcccggggccttggtgtagctgccggtggtggcgcggatatacagctcgcgggccttggcctgatcgcaagggtcgtattcgtagctgatcgacaccggggtcaggttcagcgactggatgacttcgccgaacggctcgtccttgcggctcatgtggaacatcttgaggatcgccgactcggtacggtcgtcgccgtccttggcccggccttcggcctgggcaatccagatcgacgcgcaatcgttgcggatcgagtggttgatgtaggccgacagcagctggtaggcggccatcttttcccggcgtccggtgatcgaacggtgcacgatgaagctcttgttcaggcgcatcaggtcgctgacgaaaggcttctgcagcaggttgtcgccgatggcgatgcgcggggtcggcaatccggcgtggtacaccgcgtaattgacgaaggccgggtccatcacgatgtcgcggtggttggcgatgaacaggtaggcgctgccggacttgaactgctcgacaccggtgtaggtcacgccgtcggtggcccgttcgatggtgtggtcgacgtagaactcgaccttgtcctgcagggtcgccaccgacgtgaccgcggcgaactcacggcgcagccgatgagctataaggggtttgagcagccagccgaaagcgccggcaaagcgcgggaagcggaagtgggtgaggatatctagaaacgccttgtcgccgagcagtcgagccagcaccgctggtacttcactgtcgtcgtaaggtcggatggcatcgaattcgcccatcatgctctcttgttggaaacggctaggtaagaaaaggtttggatcgaaaaatagccgggcgcggtctgaaaagtaagctcagatctcaatagccctgcaaatagaccggcgattatacgcacaagtcactccggaggccgcgatgctggaaaccgagcgctatcaatgtccctactgtggcgaagaggccgaggctgtactggacctgtccgggggcgatcagcagtacatcgaggattgtccggtctgttgtcggcccattgtgttcaccctgcagaccgacggtcaggaatggatgctcgacgtgcgcagcgaaaacgagtgacggggggctttatgcagcgaatctacgaaccggaaaacctgctggaggcggagttgctccagggcatgctggccagcgagggggtcgaggcgcatctggtggggcgggatttgcttggcggtaccggggagttgcccatgttcggcctccttgggctggcggtggataacgaccaggcgcaatacgctcgggagctgatcgccgcgtacaatgccgcgctgccgatgcccggcgacgagccggccaatcatgccggcgtgctgatctgttaggctggccgccgattttccgagagttgtttgccccatgtgtggacgttatgccctgtttcgctggaaccaagcgtttgccgccttgcccggatttccggcggaccagcaggcgcagtggaacatttcgcccaacgattcggtgctgatcctgcgcagcagcgacggccagcgcaaccttgcccgcgctcgctggggcctgacgccgccctggctgaccgatctgtcgcgcaccccggcccatgcccgcgccgaaaccctggccgaacagccgatgttccgcgaagcctttcgccagcgccgctgcctgctgccggccaacggtttttacgaatggcgcggcggcacccgcaaacgcccgtactggctgacgccgggggagggttcgtcgctgttcttcgcggcgatctgggaagcctatccggtgcaggaacaggtctggctgagcaccgcggtggtcacccagccggcggccagccagcgtcggccattgatcctcgatgcccagggccaggaagcctggctcgaccccgatacaccgttgccggtgctgcaagccttgctggccagcccgccggcggccttgcgcgagcgggtgctggccaacctggtgaacgatccgaagctcaacgccccggaatgcctgaccccgggttgacgccgtccctgaatcgcgtggcctgattcggcgagcgcttcgcacggagtgccgtccagctcgatcgcagcctgcggcagcggctacagagcccgtgtcgggctgttgaatcgcgccgcaatccctgtagccgctgccgaaggctgcgcaaggtccgcaggaccttgagcgttagtacgggccacgcctgctttgcggccggttgcagtggcttataccttgaactgattgatcaggcgccgctgctgctcggccagcttggtcaggccggcgctggccgcgctggactcgtcggcgccgcccgccacttcgttggccacctggccgatattgatcacgttgcggttgatgtcctcggcgaccgcactttgctcttcggcggcgctggcgatctgggtgttcatgtcattgatcaccgacaccgcctgagtgatggtttccagggcttcggccgctttcgccgcatgctgcacgctttcgtcggtgcggttctggctgtcctccatgacccgcaccacatcgcgggtgccttgctgcagttgctggatcatcgactggatttcttcggtcgcctgctgggtcttctgcgccaggttgcgcacttcatcggccaccacggcaaagccgcggccctgttcgccggcacgggcggcttcgatggcggcgttgagggccagcaggttggtctgttcggcgatgccgcgaatggctatcaggattgcgttgatgttctcgctgtccttggccagggtctgcacgacgcccaccgcccggccgatttccacggccagggcgccgatggcggtcgaggtgtcgcgcacgatccgcatgccctggctggcggcctggtcggcatggttggcggcttgcgcggcctgggtcgcgttgcgggccacgtcctgggcggtggcggtcatttcatgcacggcggtggccacctggtcgatctcggccatctgcttgtgcacgccctggttggtgcgaatggcgatatcggcggtgtgttcggaggagtcgctgacgctctgcaccgaggtcaccacctggctgatcatcgcctgcagcttggccaggaaggtattgaagcccttggcgatcgagcccagttcgtcggcgcggtcgctgctcaggcggcgggtcaggtcgccttcgccctgggcgatatcgtcgagcatggccaccatttgtttgagcggacgggcgatgccgtggcccaccagccagatcaccagcaggccgaggccggcgatgatcaggccgaccatggccatgccgaaggtgtcggccttgcgttgttcggccaggtcgctctgcagtttctgcaggtcggccatgacagcgtccagcggcagttgcagcatcagggtccagcgggcgtcggtctggccaatgccgaacggcaggtacagctcgatccgcccgttggcctgatcgacgttgtagttcacttcgccgcgcttgaggttgcccagcttggcgacttcttcgctgtcgagaatgtcgctgactttttcgccgaacttgctcgggtccttggtgtaggccaccagccggccattgccaccgatcagggccatttcgcccacgccgttatagagttttcggttggcgcccaggagcatgtcctggatgaagttcaccgacaggtcggcgccgacgatgccctggaaggccccgtcgagcaggatgggttcaataaaggaggcgagcatgacgatcttgtcgccgaccttgtacggcgccgggtcgatcacgcaggatttccggctttccttggagcacaggtagtactcgctggcacgcacgccagtggacaagactttctggtcgtccacatccaccagtttgtccaggcccaggctgccgtcttcgttacggaaccaccacggcaggaagcgtccgttgctggcatcgatacccaccaccttggtgtcgacataggcgctgtcgttatggtcgatggcgttcttttcccagcctatataggcaccgagaatcttcgggttctgcgcgacgttttccttgatcaggttgatcagctgctcgcggctgagattgagctgtggattgccgtccgcgcccttgctgccgatcagtgcgttgacccgcaccagcccgccggcgatcagcaggggcgcctcgagttcacgctggatctggctgacctgggtctgcgccaggccgaccagtcgctgctcgatgacttgctcgaactgagcctgggtttgctgctgcaccatctcctgggtccgggcgccggcgaacagggcgtacagcaccagggcaacgaccacgctgaggacgatggcgccggccagggcggccacggaaaactggatcgacttgaatttcataagggctccggacgcaggaatgacgtctgccccgttgtatcggcaaggccctcgccgaccatgagcgaggatcggaaaaatgaccgttttgtaggctggcatgtcgcaaatgggcagctgccggccgttgtcgggcgcggaggggagggctctgtgaattttttcctacgctgctccgtatctgaaaacagcgtgctacacgtccgttgtatctggcgtcgatacacaactgagcctaggatacgcgccatgttttcagggagcgttttcatgagtaagaagcaggttttgggtgcactcaccgctgcgttgctgctgtcgggttgccagtcggtcaacaccaccagcggtggcgctgtcggcgtcgatcgcaagcagtacatgttcagcatgctgtcgaccgatgaggtcaaccagtcctacgcgcagtcctatcaacagacgatcggcgaggcgagcagcaagaacgtgctggacaagtccagtgccaatgccaggcgcctccaggcgatcgctaaccggctgattgcccaggccccggtgttccgcccggattccgcgcagtggaattgggaagtcaacctgatcaagaacgatgagctcaacgccaactgcggccctggcggcaagatcattttctacactgggatcatcgacaagttgcagctgaccgacgatgaaattgccgcggtcatggggcatgaaatcgctcacgccttgcgcgagcacggtcgtgaagcgatgtctaaggcctacggtgtcagcgcactgaagcagatagccctgatcgccggcgcgccgcaggaagcggtcgccgtgggcgacaacggggtcaacctgttgatgaccctgcccaacagtcgcggcaatgaaaacgaagccgacctgatcggcctggaactggcggcccgcgccggctacaacccgaacgcggccatcaccctgtggaacaagatgagcaaggcttcggaaggtgcgccacctgaattcctcagtactcacccggcgtccagcagtcgtatttcctcgttggaagcggcgattccgaaggtgatgccgttgtaccagcaggccaagaggccctgatcgtcaggcgtcgttgttgacgacagggtcatgaacaagccggccccctgcaaaagaaagccccgactggttcggggcttttttgtgttcgcaggtttgcctggaggcgtgcctgctgagggtacgcttacaaccagccgctgctttgcatggccttgtacaccgcgacaatggccaggatgaagaacgccgaagccgcgaggcgacggatcagggtcaggggcagtttctccgccgcgaagttgccggccagtaccaccgggacgttggcgatcagcatgccggcggtggtgccgatgatgaccagccacagttccgggtattgcgccgcgagcatgacggtggcgatctgggtcttgtcgccgatttcagcgaggaagaacgcgatcagcgtggtcaggaaggggccgaacttgcgggcggtgctggcttcgtcgtcgtccatcttgtccggcaccaaggtccagagcgcggtcgcggtaaagctcgcggcgaggatccagtgcaaggtcgcgtccgagaagaagctgccgaaccaggcgcctaccgcaccggctgccgcatggttggccagggtcgcggcgacgatgccggcgatgatcggccagggtttgcgaaagcgcgcggcgagaatgagggcaagcagttgcgtcttgtcgccgatttcggccaaggcaacgatcgcggtgggaaccagtagagaatccagcatcagggcattcctaaggggcgggtcgacacggctatgacacgtacagccttcccgccccgggtaaggtgtgcgtgtcataggtcttgtcaaaccctgcggtccgtctgtgcggactcttgggtcgcatgcgccatgatctgaggatcaagtatgttgacgcatgccgggcgagcgtggcgctcgcgggagactactcccctaggacggagcggattctgcctaggcaaaatccattcggcaagcgttcttttgcaaaaaggttttcagccgcgcttggcgctgtagatgcgaaaacccaggccttcggccttgatcgaacaagggcccagatgctcttcgatcagcggttgataacgcaggaagctgttggccaccagccgaagttcgccccctgttttcagatgtttggctgcttttcgcagcaggttctccgttgcctggtagtccgtgtggaccccgacatggaacggcggattggtcaggatggtgttcaagcccatgggcgcggcatcgatgccgtcaccggtcaggacctcggcttccaggccattggcggccagggtcaggcgactgctggcagcggcgaaggcatcgacatccagcagggtcacattgttatgtgggtagcgacgtttgatcgccgcgcccagaaccccggcgccgcaaccgaaatccagcaggtggccgctgggcagtttgtccaggtgttccagcaacagggcgctgccgcgatccaggcgaccatggctgaacacccccggcaggctgaccactttcagcggcccttcggccaacggcagttcatattcctgggccaggctttccaggctgacggcttgtggcgcgttgtctaccgtcacttgccacagctggcagtgccgcgcgctgtcgagcttgcgcggtttgccgaaggggttgagctgcttggccgcgcgttcgatgccgctgcgtttttccccgaccagatacagctcgcgcccggccaggcgcgaggcgagggcgttgagcaggtagtcggtcaattccttggacttgggcaggaacagtacggcattggcaaaggcttgctcgggggccgtcacgccgaagtggctgcgcccggcgaaacgcgcatccagggcggcctgatcgccggcgtgccagcaccagccatgggcgtccggcaggcggccgagcaggtcatcggcgggcaggccggccagcagcagcgagccttgaaacaagtcagcctgacgaagcagtacttcactgcgcggatccataatctgctcctgggaaaaaagtggcgcagtttatcaactgacgacccgcagcgctgtaccgctgaaaaacgcctgggcgttttccgccagctggccgacgatgcgctgccgggcttcgcggctgccccaggcgttgtgtggggtcacgatcagccgtgggatgtcatgggccagcagcgggttgccagcggtcggtggctcgacgctcaacacgtcggtggccgcgccgcccaggtgaccgcgacgcagggcgtcggccagggcctgctcgtcgatcaggccgccacgggcggtgttgaccacaaaggcctggggcttgagcagggccagctcccgggcgccgataaagtgccgggtgtgttcgttgagcgggcagtgcaaggtcagtgcatcgacttgcggcagcaattcatccagcggcaggcggtcggcgcgggccgggcggccgggaatctgccccagcagcacgcgcatgccgaaggcctcggccaggcgggcgacggcgccacccagctcaccatggcccagcagacccagggtcttgccttgcagttcgacgatcgggaagtccagcaggcagaactgccgggcctgctgccagcgaccatcgctgaccgcctggcggtaatcgccgaggcgggtggcgaggttaagcagcagcatgagggtgtgctgggccaccgatggcgtgccgtagccctggcagttggcgacggtgatgccctgggcgcgggcggcggccagatcgacattgttggtgccggtggccgccaccaggatcagtttcagttcggggcaggcggccagggattcggcattgagcagcactttgttgctaatcgccacctgggctccctgcaggcgctcgaccacctgttcggggcgggtccggtcatgcagttgcagttcgtcgaagctgtggcgcagcgcgctgaggtcgaggtcgccgaggtccagggagctgtggtcgaggaagacggcgcggcgattgttagtcatcaactgtaccttttgcacgagggtctgaaggcgtaatctgccgagcctaacagatgaaataattagaaacacaggagtgtccatgtacctcgccgagttcttgaccgtcgcccttattcacctgctcgcagtggccagcccgggcccggatttcgccgtcgtggtgcgcgaaagcgtgacccacgggcgccgcgccggcacctggaccgccttgggcgtcggcaccgcgatcttcctgcacgtggggtattcgctgctgggcatcggcctgatcgtgtcgcagtcgatcgtgctgttcaacgcactgaaatgggccgccgccgcttacctgctgtatatcggctacaaggccctgcgggcgcagccggccaagcccgctaccgagaacctgcacctggaagctggcgagcgcaccgcgcgcggcgccttcacttccggcttcgtgaccaacggcctgaacccgaaagcgacgctgtttttcctgtcgctgttcaccgtggtcatcaatccgcacacgcccctggccatccaggccggttatggcgtgtacctggcggtggcgacggctatctggttctgcctggtggcgctgctgttcagccaacagaaagtccgcgccggttttgcccgcatgggccactggttcgaccgcaccatgggcgcggtgctgatcgccatcggggtgaagctggcctttaccgagatgcattgaggcggtctttctcgtccaggttggtcggatatttctgatcattaattgggattaatcgtacaatcgtccgcttttatgccactccggcaggtcgagcccgttgaccgtccggagagcgcgcgagaccggacgcttgatgacgatacaaaaagtaccgcagcagttgctctatctggtttatggcggcaaagaggtttatcgccatgaagcgaaattcagcattctgacggccctcgaccagagcaagagtgccgaaccgctggtgattcgggtcatgaccgaccgccccgaggattaccgcggctggccggtgcaagtggtgccgttgagtgagcaaacgctggtcgagtggcagggggatcagggctactaccaccggcgcaaggcctgtgcctttgccgcaggcctcgcgctggcggacaagaccctgtttgtcgataccgacaccttgttcgaggccgacccgcagcggctgttcgatcgcatcgcccccggccggtacctgatcgatgaagacgagtttctctggtccgaggtccgtacccgccccgagttcgtcaaactcgaccgctacctgcaggccagcggtcagtcggtagccgacgaccagcgtctgttcaacagcggggtttgtggcctgacggccggcgatggtccgctgatgcaagcctcgattgccttgattgacgaatggagcgcccacatcaaggacctgcacaccctggaacagatcgccttgtcatttgccttgcgcggtcaatccgtgggcgagagcaagagttgcatttatcactacttctccgacaaggacttcttccacgccatgcaagcgctgttcttccagcgccatggcgaagccttccggccggagttgctgcgcatgcagcgcgaggtcccacggcgtaaacccttgccgtcgctgtttcagcgctcgcggatcaagttctacttgaggcggcagaacaaggacatgcaaaaagtcgggcgcgacctgctgtatggcagcggcggtccgatctcgccctatgtcgaggcttgccgccatgtctggtgggatcaggggctgcgccagatccagcgccggggcatgagccagcaggcgccgattcgcgcgctggcgcgtggcgaatggccggccgggttgccccggccgcaaaaccgcgacgtggaaaaacgcctgcgccactacctgcaacagcatttgcagccgcacgggcctgcacacggggctaagtgatggggcctagtgccttgaactgatccagggcgccgagatattcccgcggagggtggccgagcaagcggcagaacatcgcgctgaaggcccgggcgctgccataacccaaggctgtcgccacttgctgcaggctctcgccggcgatcaagcgtggcagggcttccatcaggcgcagttgctggcgccaggcattgaagctcatgtgcaattcctgctgaaacagccgcgccagcgttcgtgaactggcgccgacctgctgcgcccagtcttccagggtattggcatgatccggcatctgcagcagcgcctggcaaatggcttgcaggcgccggtcgcggggcatgggaatatgcagcggcaggttctccaggcgggcgacttcttccagcatcagttgctggatcagtgggttttccgcgtgttcgcgaccctgcacggcccgcaggatcagttcgcgcagcagcggtgtgaccgccagcacgcaacattgctgcaacgagggcggcgacagctcgggggcgatgaacagcgaacgcatgtgcacatcgccggccatgaagatttcatgttccaccaggggcggaatccacaccgcgcgggtcggtggcaagacccatgcgccctgggccgttaccacgcgcatggtcccgcgcactgcgtacagcagttgcgcctcgcgatgccggtgcaactcctggtgggcgccgtcgagataatcgcgtggataggcgctgaccgggccgtgctgaaagtggctgattaacatgtctgatccgatgactttattgtcaggagtgcgttttatagccaacctagcataacggcatacctacaacgaaacagtgtgccgtcatgaatcagtctcgaaacgtaatccgctacatcaacgccgcccatgtgatcgatcacatgttcatgctgatcttccccgccgctgtgctcgggatgacccgggccttcgacctggactatgccgcgctgatcggtctttccctgggtggcttcattgccttcggcgcctgttcgctaccggccggctggctgggcgaccactggagccggcggcagatgatgctgctgttcttcttcggtatcggcgcctcggcgattttcaccggcctgagcagcagcccgacgatgctggtggtcggcctgacgctgatgggggtgtttgccgcgatctaccacccggtgggcacggcgatgctggtggcctatgcgcagaaccgcgggcgggagatcggcatcaacggcatgtggggcaatctcggcgtggccttttcggcattgatcaccgggctgctggtggcgcatttcggctggcgttcggcattcatcctgccgggcgtggtggcgattgccctgggcctggggtttgcctggcaggtgcgtgaagaagccatcccggcacggcctcatgtgcggctcaagggcgcggatggccagcgtatttccatggccatggtgtttggcgtcctggccctggcaaccgcgactggtggggtggtgttcaacgccaccaccatgacctacccgaagctgttccaggagcgcctgcaggacctgttcgcttcgccgcagaccctgggcctggtggtcagtctggcgtatgccttcggcgctgtggcgcaactgagcattggtcgggtactgcatcgcttcagtctgaaatggccctttatcttcttgaccctgtgccaggcgccgctgctgttcggcctggccgaggtcgagggctggtcggtcatcgtcctgggagcggcctttatgttcgtggtgttcgggcaggtcacggtgaacgatgcgatggtcgccaacttcgttgccccgcagtggcagtcccgggtgtttgccttgcgctattgcctgtcgtttggcgcgagcgccacggcgattccgttgattgcctttgtcgaaccgcgccaggggctgaccgggctgtatctgatcctgagcggtttcgctgcgctgaccttcgccgccgcgttgatcttcccgcgtaccccggcggaggccgcggcagggcaggccgcttgagggggcacaggagtgtcttcgcgtgaatccacggtcgcgcgaatgctggcttggagctagcattcgtacggctctgcaaatcattcctttggctgatttggcagagccagcggcgctctagagtgagcgttcttcagccacgaccgtgcagtcacgaaaagggatgcttatgttgcagactcgcgttattccgccagccgaaggcgcctaccaatacccgctattgatcaagcggctgctgatgtccggcacccgttacgagaagacccgtgaaatcgtctaccgggacaaactgcgttacagctacccaaccctgatcgagcgcgtggccaggctggcgaacgtgttgacggctgccggggtcaaggccggggataccgtggcagtgatggactgggacagccatcgctatctggagtgcatgttcgccatcccgatgatcggcgcggtgatccacaccatcaacgtgcgtctgtcgccggaacaaatcctgtacaccatgaaccacgccgaggaccgcttcgtgctggtcaacagcgagtttgtcgggctctaccaggcgatcgccgggcaactgagcacggtggagaaaaccctgctgctgaccgacggcccggaccagagcgccgacctgcccaatctggtgggcgaatacgagcagcttctggcggctgccagcacccagtatgctttcgaggatttcgacgaaaactcggtggccaccaccttctacaccacaggcaccaccggcaatccgaagggcgtgtacttcacccaccgccagctggtgctacacaccatgggcgtggcggtgatcatgggcagcatcgacagcgtgcgcctgctgggcaccagcgatgtgtacatgcccattaccccgatgttccatgtgcatgcctggggcctgccttatgtggcgaccatgctcggcctcaagcaggtctatcccggccgttacgacccggagctgctggtggagctgtggcgcaaggaaaaggtcaccttctcccattgcgtgccgaccatcctgcagatgctgctcaatgccaaggcggcccagggcacggatttcggcggctggaagatcgtcatcggcggcagcgcgctcaaccgtgcgctgtacgaggcctccaaggccaagggcattcagctgacggcggcctatggcatgtcggaaaccgggccgctggtgtcctgtgcccacctcaacgaagaactgctggcgggcaccgaggatgagcgcactacctaccggatcaaggccggcgtgcccggacctctggtggaggcggcgattgtcgatggcgacggcaacttcctgccggccgatggcgagacccagggtgagctggtgctgcgcgcaccctggctgaccgaaggctatttcaacgagccgcagaagggcgcggagctgtgggaaggtggctggctgcacaccggcgacgtggcgactctcgacggcatgggcgtgatcgatattcgcgaccggatcaaggatgtgatcaagaccggaggcgagtgggtatcgtccctggccctggaagacctgatcagccgccacccggcggtacgcgaagtagcagtggtgggtattcccgatccgcagtggggcgagcgcccgtttgccttgctggtggtccgtgaagggcatgcgatcgaggccaaggagctcaaggagcatctcaagccgtttgtcgaacaggggcacttgagcaagtgggcgattcccagccagatcgcccttgttactgaaattcccaagaccagtgtcggcaagctcgacaagaagcgcatccgcctcgacatcaccgaatggcaggccaacaacagcacctttctttcgacgctataaacaccctctaccgtgcccgaaagggcacggtagagcccaccaagcaagcgcttgccttgtcaaatccgaattttcagccatccttgccgtgccggcatttgccggactggcgaaaggaccgttccagagtggttggaggctgcaaatcacactttagagggatcaagccgtaccacctgctggctatagtccgcccaaggatttttaagaacggggcaaccgcacaacatggggcgatgcaactttgaacgacttcggagctgactgggttccgcccgttcagagcgtttttaaaagtgctcactgccataacaataaagcacatggagtagcgtcgatgacatcagtaaaccagttctggcgccgggcgaaactgcctctggccgtcagtctcgcctctacgctcgccggacctgccttcggcgtcagtttcaacatcggtgaaatcgaaggtcagttcgactcttctctatcgctgggtgcgagctggtctacccagagccccaacaagaatctgattggtgtcaacaacggcggccatggcctgtcccagacctccgacgatggccacgctaacttcaaaagcggcgaaaccttttccaagatcttcaagggcatccacgaccttgaattgaaatacggcgataccggcgtcttcgtccgtggcaaatactggtatgacttcgagctcaaggacgaaagccgcgagttcaaggacatcagcgacagcaaccgcaaggaaggcgccaagtccgccggcgggcagatcctcgacgccttcatctaccacaactactcgatcgccgaggagccgggttccgtgcgcctgggcaagcaagtggtgagctggggtgaaagtaccttcatcggcggtggcatcaactcgatcaacccgattgacgtatcggctttccgccgtcctggcgcggagatcaaggaaggcctgatcccggtcaacatgttctacgtttcccagagcctgaccgacaacctctcggccgaagccttctatcagctggaatgggaccagaccgtcgtcgacaactgcggcaccttcttctcccagccggacatcatcgccgacggttgcagcgacaacctgcgggtgctgaacaagcgctcgaccattccgtcgattgcccttgggccactggccgccgcgggcgtcgatgtcaatcaggaaggcgtgttggtgcgtcgtggaccggaccgcgatgcacgggacagcgggcagtggggcgtgtccttcaagtacatgtacgagccgctcgacaccgagttcggcgcgtacttcatgaactaccacagccgtgcgccgatcttcagcgccaccggtgctccgcagtcggtcttcgaccgtgtcgcggccttgcctccagcgttccgcgccctgggcccactggtggtggcgggcagctccgagtacttcgtcgagtaccctgaggacatccgcctctatggcctgagcttctccaccaccttgcctaccggtaccgcgtggagcggtgagatcagctatcgcccgaacgctccggtgcagctgaactccaccgatatcctgttcgccggtgttcgccccctgggcggcaccctggccaatgcctcgctgctcgacggctccccaggtcaggacctgcacggctatcgccgtaaagagattacccagctccagaccaccttcacccacttcttcgatcaggtcatgggcgccagccgcctgaccctggttggtgaagtcggcctgacctacgtgggcggcctggaaagcacctccaaggttcgttacggccgcgatccggtctatggcccgggcgaactgcctgccaccggcagcctggacacctgctcgcagatcctcaataccagcaccatcaacggcgcgggtccaggcgcggcgaccaacaatcgcagccgcaactgcaacgacgacggtttcaccacctcgacttcctggggttatcgcggtcgtgccatctgggaatacaacgacgtgttcgccggtgtgaacctcaagccgaacgtggcctggtcccatgacgtcagcggttactcgcctggccctggcggcaacttcgaggaaggtcgcaaggccatcagcctgggcgtggatgccgagtaccagaacacctacaccgcgagcctggcgtacaccaacttcttcgacggcaagtacaccaccgtggatgaccgtgacttcgtggccctcagtttcggcgtgaacttctaagcactgcattttcaggaagaacaagaatatgaaagtaaccaagagtctgttgcaggtcggtgtcctcgggctgtcgctgctggcgaccggggtcatggccgcggtctcggccgatgaagcggccaagctgggtacctccctgacgccgatgggcgcggaaatggccggtaactcagccggcaccattccggcctggaaagccttgccgaccaacgccggcagtgtggatggcaagggtttcctgtccaacccgtacgccagcgagcagccgcagttcaccatcaccgcgcagaacgtcgagcagtacaaggacaagctggcgccagggcagtacgcgatgttcaagcgctacccggaaacctacaagatgccggtctatccttcccaccgcggcgccacggtgccagccgatgtgttcgccgcgatcaaggaaaacgccaccaagaccaacctggtcagcggcggcaacggcctggaaaacttcaagaccgccattccgttcccgattccgaaaagcggcgtggaagttatctggaaccacatcacccgctatcgcggcggcagcgtgacccgcctggtgacccaggcgacgccacaggccaacggctcgttcagcctggtgtacttccaggaccagttcgtgttccgcgacaagatgaaggactacgatccggcgaacccgggcaacatcctgttctacttcaagcagaaagtgaccgcgccggcgcgtctggccggtggtgtgctgctggtgcacgaaaccctcgaccaggtgaaggagccgcgttcggcgtgggtctacaacgctggccagcgtcgtgtgcgtcgcgccccgcaagtgtcgtatgacggtccgggtaccgccgccgacggcctgcgtacctccgacaacctcgacatgtacaacggcgcgccggaccgctacgactggaagctggaaggcaagaaggagatgtacatcgcctccaacagctacaagctcgactcgccgcagctgaagtacgccgagatcatcaaggccggccacatcaaccaggacctggctcgctacgagctgcgccgtgtctggcacgtggtcgcgaccctgaaggaaggtcagcgccatatctacgccaagcgtgacttctacatcgatgaagacacctggcaggccgcggtgatcgaccactacgacggtcgtggccagctgtggcgcgtggccgaggcgcatgccgagaactactacgacaagcaagtgccgtggtatgccctggaaaccctctacgacctgcagtccggccgttacctggcactgggcatgaagaacgaagagagatcggcctacgacttcggcttcaccgccaccaccagcgacttcactccggcggccctgcgccaggatggcgttcgttaacccgcggtaaatcgaggcgcatcctcgatcgacgccccgactggttcggggcgttttttattgtctgcgtttttctacaaggcgcggggtggcctctgtagaagcgagcttgctcgcgaaaaaactccagacaatgccacctcccggtaaaactgcactgcctttatcgcgagcaagctcgctcctgcaggtacgcggggagcgctgacaaacctggttgtattctttttctatccatctgtagcaaaaatcttcaacagggggctttttaccgctagtctgccgacatctgtattgccgacaacagcacttcaataagagttggccatgactgatctgtcccgtatccaggggcctgccggtgcggccattcccgcgccggaagggcgcttctaccgacctcccttgcccgacggctacgtactgcggccgcgtctgtgcgagcgcttgagcgcgggcctcaatggccggctgctgttggtcagcgcaccggccggttttggcaagagttcgctggcggtggagttctgccaaagcctgccgccgcactggcgcagcctgtggctggggctcagtcgccgggacagcgatccgggacgtttcctcgaacgcctgcttgaggggctgcaacaatatttcgcccaactgggcaaccaatccctcgggctgctgaagatgcgccagcgccaccagcccttcgccttcgaagagtggctggacgggctgctcgatgagttggcggcccatctttccagtgtttctcccttgttgctggtactggacgattaccacctggcccaggggccggtgctcgatcgctgcctgcagttcttcctcaatcatttgcccgacggcttgctggtgctggtaaccagccgccagcgcgcggactggcacctggcgcgtctgcgcctgtcgcggcagttgctggaactgcatgagcaggacctgcgcctgacctacgacgaatccctgaccctgctcgaccggcacagcagttcgctgcgcggcgaggcgctggaaagcctgatccttcgcagcgaaggctgggtggcggggctgcgcttctggctgttggcggcctcggaggcgggcagtggctcaaccttgtcgcagtcgctgaatggcggcgaaggcctgattcgcgattatctgctggaagaggtcatcgattgcctgcctgccgaagtgcagtcgttcctctacgacacggcgccccaggaacgtttctgcagcgacctgtgcgatgcattgcgcgagtcccacgacagtgccgagatcctgcgttacctgttggcccaccaggtattcctggtgccgctggacgagcaggggcactggtaccgttatcaccacctgttctccgacctgctgcgcacccggcccaccgccaacgcgatattgccgccggccagcctgcacctgcgggcctgtcgctggttcaacgcccaggggctgctggacgaagcggtggagcaggcgttgcgcgccgggcacctggacgtggcggcgaacctggtacagaacctgtccgaggaacaactgctggccgagcagaacgtcggcatgctgctgcgctggaaaatggacttgcccgacagcctgctgatcagcaccccgcggctgatcgtgctgtacagctgggcgctggggctggcgtgccagctggacgccgccgaagagctggccagccatttgagccgcttcctgccggccccctcggccaccgcgcagaaatccatgctggcgcaatggctggccttgagcgggatcgtcgcccgcggacgggggaatcgcgagctgaccctgctgtattgcaccgaagccctggaaaccttgccgcagaagcgttacgggcagcggctggtgtgcttgtcgaccctgtccaacctggcgatcgccgatggcgacctgtggcgtgcccgggggctcaaccgcgagtccctggaactggcgcagcgggtcggcaaccccttgttcgaggccctggcccattacgaccgggcccgggtgctgcaagcccgcggcgagatcctgcgggcgctggatgaagtccgccagggcttgcagcgcttgtatggcctgtccgcgcaacgcctgtacgcggtacgggcgcggctgactctgtacgaaggttacctgctggcgttgcgctgccagcccgagaccggactggcgcgcctgcgggcggggctgatcgaggcgcgggcctgtcgcgatatcagcgtgctgatcggtcattgcgtgatcgccaacctggaaggtcacaacggtgagtttgccaaggcctttgccgaactggccgaggccgaacgcctgatgcacatctgggacgtaccgccgatctactacctggcgatgatcaccttggtcaaatgcgaactctggctggcccagggccgcacggacctggcgcaggcctggctggctcgcctggggcagacctacaccggcgacctggccgccgcggcaccggaatttcatccacaactgccgctgcatatcgagttgcagcaagccttgctcgacagcatccagggcgagccggccctggccgagcagcgcctggacaaactgctggagcatggccggcagaccgggcggcaaatgctcaatgtgatggcgttgaaccagaaggtcgcgctgttgctggcccaggggcgcgaccccgaggcccggcaggcctttgcccaggcgctggaggctgccgtgggtggggcattgcaaccgttcgaatgggcggtgcgggcgcatccggcctgggttcgcgagcaacttcagcagggggcggcgacaccattgcgccaaaccttgctcgaacgcctgccggccgccgtggtacgtgattccctggagcagcatcacggcgaagccctcagctcccgcgagttggcggtgctgcaactgatcgcccagggctgttccaaccaggaaatcagcgatcagttgtttatctcgctgcacaccgtgaagacccacgccagccatatcaacagcaagctgggggtggagcgtcgcacccaggccgtggcccgggcccaggagttgggattactgggctgattgagcggtcagctgatcttgcgggtatcgtcctcggctcgctcctggggcgaagcagggggctctgcggtgttgaagtccagggtcacggtgaagcgctgttgttcggtgaggagctggatatgccagcccagcctggcgcacaactggcgcatcagctccaggcccaggccgtagccgaagtcgctggattcttccgcctggctggtatcacggatacggttgacgatgcgcagttgcagctgttcgaaggtgatttcgatgctgccttcttcagcatattgcagggcattgcgcagaaagttaccaaccacgattcggcaggcggtcaggggcaggcgacaaggctcgttgctgatgtcgaggatcagttcgatatcccgcttgccgatcaggtagcgatgctcctggatcaattcgttgaacaattcggccatgtcgatggcttcttccggcaagggttcaacgcgctcgcggctcatccacagtagcgtctcggcgatgcgctgcatgttcagcaccgagcgttcgatacgttgcagaggcaggggcagcgagcccccggcctgcaaggtcagcagttccaggttggccttgagcaccgccagcggcgtgcgtaactcatggctggtgtagcgcagcaggcgcccttcgcgctggctggcggcctgcacctgctgcacgctctgggccagggagtcggccaggacattgaactccttgaaacggaaattcgggcgttggctggacaccttctccggatctttcagggtggtggaccactgggccagccggccgagggggcgcaccagccaccagaccagcagggcgatgatgatcagtgccgggatgaataccgccagactgatgacattaatgctgttcagttcgtgatcgagataggcatcggacaacggggtctcgagctcgccaccttcttcatggtcgtggtcgacatcgaacatgtagaggattttgccgtcacccaggggctgggccaggatcgccttgacttcatcctgtccatcggcgtccagttcaccgaacacctgcacggcgccgaaggacagggttggcggcgtatccagtaactggcgaattttcggtggcagcgcttccttgccgataacgctgttgaagaaatagttctgcggcggggcaaggcttgggtctttcttgtagtgcctgacgaaatacagggcttcttcttccatcatggcgctggcggtatagagcaggccccggatgctatagctcgatagcagctggctgtagatcagcagcaccacggcgatcaacagcaggaaactgccgctgatcacccatttcagactcaggcctttacgcatggggtcctcagctgcacaccgacgccagaaatagtgtggatcagcgcttggctgaaatccttgtccaccgccttgcgcaagcggtgcatgtgcaccttgagagtattgctgtccggcggctcgtcgccccagaccgtcgcctcgagacgttcgcgccccaccggctcgggactggcacgcatcaggcattccagcagggtccagcaggtgggcgacaggtgcagttcctgtccggcgcggctgaccttgcgggtggacagatccatggtcaggtcggccacctgcaggcggctggcctggccgctgcgccgcaggctcagggcgcggatcctggccaccagttcggccagttcgaagggcttgaccaggtaatcgtcggcgcccatggcaaaactggcgagcttgtccggcagggcatccagcgaggtgagcatcaggatcggtgtctgcttgccctgttcgcgcagctgtttgcacagctgttggccgtccaggcgcggcagcatgatgtccagcaggatcacatcatagtgttggctcagcgccaggttcaggccggtctggccattactggcgtgatcgcagacgatcccggtgatctccaggtattcgatgacggtgttggccaggtcgaggttgtcctcgaccagcagcaggtggatatgcacgggaacgtccccttggacctgtgtcgctcagtggcccagaggataacggagccggcgcgttttttaccgatgtttacctggcgttaacctgtcgggctctagggtggcggcttttacaccaagagaacgccaccatgaacctgtctcctgtcgccaaaggcattctgctggtcttgattgtcatcggcctgatggcctgtgccttgtcgcccggcacgtctgtggcgcgcctgggcgggggtgggccgctgtcagggttcttgaccgggaatgggggcgggctggcagcaggatcgggctctattgcctatgccttctgaaaagacctgcgcggattacaccgaccagttggtgctgtgcctgttgctgattctttgcgtggcgcttgcgctgggcacctatatcgtccggctcaatgcgcgtatcgatcaacagcgtgagctgtcgccggtgcatctgctggagtgcggcaacgggcgcggggcttttatcgtcgatccccacggccggcgcagcagcagtgacaattgttatctgatcgaagaggatgagtagccgatgtagcggccccgggaaaatccggcactgagttcaagcgcaagaaacgtagttcttgcgcttgaatgtcgatctacagtgcaggcgtaccgagatgaaggccaggtccgggcctgatctccctggaagataaaggaggcttgtcatgtcctgcgtattcaaattgatcaactcgcctgtcggtcaactgaccctggttgccagaggcacgaagctcgccgcgattctctgggagaacgaacgcgaaaaccgggtgcgtctcggcccgttgcagcctgccgacgatcatccggtcttgctggaaaccgaacgccagctcaaggagtactttgccggtagccgcgatcgcttcgaactggaactggactttgtcggcaccgagttccagcgcaaggtctggcaggcgctgctgaccattcctttcggtgaaacccgcagctatagccagattgccgcgcaggtgggcagtcccaaggccgtgcgcgcagtcggtgcggccaatggccggaacccgatctcgatcatcgcgccttgccaccgggtgatcggcgcctcgggcagcctcactggttttgccggcggcctgcaggccaagcagtttctgctggcgctggaggagcgcgagcagacattgcagctggatttctagcccatcacggcgtcgtaccgtccaggatctcgtcggcaggcaagcggcctgctgacaggaacatcttttttaaacaaaggtttagagcggttgccggtatatctctgattactaaccgagcgggtaataagagttttgtattcgtcaagaaaacatcacaaagcgctcgctataattcgcctggaattcaactaaagccgtatagcccgccgacttgatttctatcaggccataacagaatatagcgcgccagcgtatcgggacttgccaacttggtgggacggcagctatgtatccacgggcttaggcataataaagttcttgcatcgtcttcacctatccctgaaggtgaagtaatactgaaatataacgagttcatgacatggatagtcgactaaaatactctgactttattccggccgacgaaagcaaatcaaatgtctgtttaaaattagaacttgaaaaattgttaggtaatctgcagagggcaagttatgcctactttgccgcccctcgaaaccgcgaagtggctcctcttattatttccaactatccgtcgcgttggctgaaagcgtataagaatgccaactatcatttgatcgatccgatcattcatcacggtcttaaaagttgtgcgccattttcctggagcgacgccctccaggctgctccctgtgaaaggagtcgagagctgttccgccgttccagccaataccgcatctgcaccggcgctacttttaccctgcatgacgccggcggcatgttcagttcgctgagtctttgcaatggcgggtcgcaagccgaattcgagcgccgcatggccgatcagcaggggcatctgcagatggcgctgatccgctttcacagtcggctgttgagcctgcgggcgatggacgaactgttccccgagcctcagacggggccgctttcggccagggaactgggggtgctcaagtgggtgatgatgggcaaggcctaccgggaaatcgcggtgatttgcgcgatttctgagcggacggtcaagtttcacatgtcgaatatttccggaaaactgcaggtctgcaatgccaagcaggcagtttacgaggcgcagcgccagggcatcctctgactaggcgctgattcgctggggttcgcagagcgctgtttcgagtgggttcaggcgctgcggccatgtgtcgaggcggctggatgacaaggggcacttgcgggcgatgttcgacagcaggcgctggcgattggcgtcactgaccggcatatccagcagcagcaccttttctcccggcgcggcctcgccggtgtccagtacttcgtagtgccagccggcattgcggacgatccgtcccatggcgttgctgaccaccgtgatgatcgattccaggccgctatgcgcggcatggttgtgcatgcacaacagcaacatttcggtcagcggcacatgggccaggccgagttggcgcgagcgcgtcttgtcgacgaaaaagcggctggactcggccatcagcgcctgcttgggcggctcgcagcggaaaaaatctcggaacggcccttcgaccatgtagggatccagggtgttgatcaggcgcaaaccggccaagggcacatttttccaggtgccgaccaggtaggtggtgcgctcgttgtcgtattcatcgaactcgatgtcatctcttacattgaccttccaattcaaacgatcggcgaatacttctttgcgcaggccatacaaatcggcgacccaggcgtggggcgtcgggctatagtcgagcgcgtgaaattcgatggattccatagtgttaaagttcttccatgggctatggtcagtactaatgactgggctcgcgcagtttgcggagagtcaacttgttccaagagaaatcaattgtacggcgcttgttagtttaacaatgtctgtccgatgacaacctgtacttaggtgcaggtacgggttgtatgaactgattttcatctcgcactttgccatctgtacctagatacagttgtcctgcctgggcaattgcgacaacttatgccgggcagtggttaagccttcaatgacgccgcgaagatgagctttttaatgttggacgtttgttccaactaacgggttcatggcttgtacttgcgagtactccacttgccttaatcgtcgaatatgccaatgacagtctgagtgtctggatcaggcttcttcacgctgcgtggcatctccagccaagacatcgaaacagggaagatcatggaaaagtccacctcttcagaaccgcgccgggtggttgtaaccggttatggcgccatctgctcgctcggcgagaatgtcgacgccatctgggacgcaatgatggattaccaggttggttaccgtcagcacagcttcgacgatccaagcatccatgcgcgttactttggttttatcgatgacttcggtcgtgaagcgatgcgtccgttctcgaagaaaatctccaagatgttgccgctgttcgccaaatacagcctggtggccacccacgaggcgatccgcatggcgtttggcgacacgcccctggatgaggtcgtctcgcccttcgagcgtggcgtgatcctgggcaccggctggggcgggctcgatactgccaacagcaacaacaacgaataccgcgagcagggcatctccacgtccttcgccaccgtcatgtcgatgtgcaatgccgcgaccgccggcatcaccatgaactggaacatgcgcggtatccagaacagtccggtggcggcctgcgccacgggcaccatcgccattggcgaggcctacgaggcgattcgcagcggccgcgccaagatgatgatcgccggtggcagcgaatccctgaaagagcagttcaacgtctggtcggtggatgtcatccaggccttgagcaaggaacaggaaaacccgcgcctggcctgctgcccgttcagtaaggggcgcagcggcttcgtgctctccgagggcgcggcggtgttgtgcctggaagactatgaactggcccgggcacggggcgcgaagatccttggcgagattaccggctacgccaactattcggacgcctacgacatgacagccccggccgaagacatgcaggcccgggtgcgggtgatcaatgacgtgtgccagcaggcaggcgtagaggcgtcgcagatcgactacgtcaacctgcacggcacctcgacaccgctcaacgatgtcaacgaaacccgctcgatcaagctggccctgggggacgcggcatacggcattccgatgtccagcaccaagtcctacaccgggcacttgatcggcgccgccggttccatggaggcggtcttctgcctcaaggccatggcccggggcacgattccggcgaccatccatatggatgaggccgaccctgagtgcgacctcaactatgtgcccaacgaacacctgcatgggcagaccctgaacaacgtgctgaacctgagcttcggcttcggtggcgccaacgccggcatcatgctgcgcaaggtggtctgatcatgcagctgcaattcggagccgagcagatcgaggcctgggccggtctctccggcgatcgcaacccgatccacttcgaccgcgaggcggcgcgtcgcatggacgcggccgatgtggtggtgcatggcatgctcgcgctgctgccggtcaagcagcgcatggggcgggtcaacccggcgctgccccaggactggatgcagttcaaggcgctgctcaagacgcccgtgctgcgcgacagcacggtagccctgtcgacccgcgaacgcagcgacagtacagggttcaagctgcactcgagcgctgacaacagcgaacatgtgatcggccatgtacgcatcgtcgaggcgccagagtggtcatccacaaccccgggtttcctgctggcacatgaggaggtcgcggcctggctcgcgcgctttcgtgatgacctgggccgggagctcgatgactgggtcgcgctcgatgcgctgatcttttcccacttcatccgtaaccatctgggcgtgatcttcgattgcctgtccccgcagttccgtcaacggcagcggccgaaccggctcgaggatctgtccgatcacctggtggtgcagaccagccaccagatcaccttctgcacatcgctgcgctcgctgggcgagttgcagaccgatattcgctgcgagatcgacaacatccacctgatcgaaagccccggcaaggccgtgggtaccctcgatctgggggtgcatgtcagcgatcgccacgtaatgaccatcaccctcggcctgatgataaaggcccttccaacctcccaaggagctatgcaatgaccactgtagagaaagtatttgccgttgttcgcgacctcatcctggaactcaaggatgtcgacgaaaacgatgtgaccctcgatagcaacatcgaggcgatggagttcgacagcctggacttcgtcgagatgcaggtcgtggtgcagaagaagatcggcgtggcgctggatcccgactcgttcgtcagccgtaagatcgccacgctgcgccagctgtgcgagttcgtggtcgagctcaaggaatcggccgctgtccctgcctgactggcaggtccaccgttacggataggagcaagggaatgtccacgctgaccaatagtgtgctcgccatttcagaagcaagagagtccaaggtccgcaagctgagcgaagtctcgcaccacaagaccatggaccacgcgaccgtgctgccttgggaccaggagatcgatcgcagcctgtacccgaaggatcccgatcacctgtggatcaatggcacgcgtttctgcgaaggcctgagcgaggcgcagaaactggaactggcctggctggaaaccggccgtgacatctccatgttcatctggctggagcagactattccgccgttgtacatgggctatgtcacccagttccacgaccgcatctcccaggacctgcaggagtacctgatgatcttctccaaggaggagatcgttcacaccctgaccttcaagcggttcatgggcaaggccggcctgcagttgtggaacccgccggtgggcctctatgagttgctgaccgagacgctgccgaagatggaacccgcggtgggcgtgctgttcacgctgctgatcgagtgggtcgcggaaatgggcgcgatgcatacgtcccaggggccaggcatcgagcctatgacccggaccatgttccgcgagcaccatcatgacgaggcccggcacatcgccttcggtcgctggatcagcgagtcgttctttgaaacggcgagccccgaatccatcgcccaggtgaaggccatgagccgccggatcatcccggcgctgatcgacatgttcacctacaacccggaaatcgcccaccacacctcgttcgaatttccgatcgcggtggatgacaaggcgaagatcgaggaagtctggcgctcggcccataacgcgcggctcaacgacgcacgttttgccgagatctacgcctgggtcgacaagctggggttgcggcaatgaaccagccgtcctgggacgcgatcttcgtcggtgccgggatcaccagcctggcctgtgcggcgatgctggtcaaacgtgaccccggggtgcgcctgctgatggtcgacaagcatattgtcgtcggcggctatgcctccacgttcagccggccgaagcagggtgcggtgttcgactgcagcctgcacaagctcagtggcatggccgagggcggcaatctcatccgcatcctgggtgacctggggctggacgagacgctggacctggtttatccccaggactacttctgcgcctaccgggacggcacggagctgccgctggccaacgatgcggacggagcggagcggcaactggtcgagcgctttccccatcaggccgaggccatcgcgaccttcttcgagcacgtgcggacctacgggcgcaacggctactaccagttccagatgctcgacggcagcttcgagccggacatggcccagttgcgtttcgcccatcgcaacctgaagcacaagaccgtgcgccaggcgctgcacgaactgttcgacgacccgtacctgatcgagatcctggcggcgccgggcatctacgtcggcggctactcggaagacctgggctatctgtactacctgcatgtggtgtacgccacgctcaaccgtggcaacgcctatgtcgccggctcctcccagcgcctgtccaatctgctggcgcagcagatcgaacaggcgggcgggcagatcctgctcagcacccgtgtcgatggcgtgctcaccgacggccagggcaatgccacgggcatcagcaccaatcgcggggtgttccattcttcgcgggtgtacatcaatgcttcaccgcattacgcggtgcagcacctgttcgcggcggatgtggaactggcggccacccgggagaaactcaccgggctgaagccggcacgctcgaccaccacggtgtacctggtgaccgacctgccaccggagcaactgggcttgcagcacagcgagtcgatgctgttcgccgatgatccggcggcaggcgccgagttgcgcatggcggccgcgctcagcggttatgaggcgcagctcagtgagcgggccttctgggagatgtcgccgatcgaggtcaccaattatcacgccctggacccggctgcgggccaggtggtgtgcatcaacgtgctcgactcgatcgcccactggccgcagcgccgcaccgcgcagtaccgggccaagaagcaacgggcctgcgacaccctggtggagcgtctgttgcgccaggtgccggggctgcgcgggcatgtgctgcataccgaggtcgccacgccccacacctatgtgcgtttcaccaacaacaccgacggttcgggttacggggcaatggtgggcaccgatctcaaggggcatgtgttccatcatggcttcccggtgcagggcgtgcagttcctcagcgcctgggtggctggccccagttacgaagctgccttcggctatgccgagatgaaggccaggcaatggaggcgagcatgagcaagaacgagcaatcgaccggttggctggggatcgccacttccaagctgttcatccgggtaatgttccgccgggtgcagggctggacgcgtgaggtgcccccccatgcggcaggctttgtggagattgcgcgcgacggcagccggctcgagggggcgtccctgcgcaccagcgccatgcatccgcggggcgtggtgctgttgtgtcatccgttcctcaagtacggtatgcattactttttcgagaacaacctggaccaggcgtttctcgagcagggctatcacgtggtcgccttcaacttcaaaggcttcggccgcagcaccatcggcggccatgcgttcgccgacgatgtgctggcgattgcccggcgcgtgtcgcgggacaaccccggcctgccgatccacctggtgggctgttcgtttggtggctatcacctgtcccacgcgctggcgcgagatgccacgcccttcacctcggccgtgctggacagcgtgccgatttcggtgcgcagctacttcacccgcgggcccttgcgactggccatgcgctggatcagcggcagtcgcctggcggtccccacgggcacctgtgccatcgaccactcgctgcgcggcgtgcgtcatcttccgatcgcctacttctacgggcgcaacgaccacttcatcccggatgccagcgtgaccgggctcagccaggagtgcgaggcgctgcacgtggtcggtttcgagggctgtcgccacctggaaaaccacaagaaacaccgggaccgctacttcgaggaaatcttcgatttcttcacccgtgcggaaactcgaaaaaccgccgtgccggcatgacggcggcagggatcatcaggtcaaaggatgtagatcatggaagttcagcagtcttcaaacggcaaatgggtactggtcagcggcggcagtcgcggcattggccgcgcactggtcctggccctggcccgggaagggtatcgggtcgcgttcacctaccagtcctcggccgacgcggccttgcaactggagcaggaagtggccgccagtggcggtctggccagcgggcatgcctgtgacggcagggaccataactcggtcgaggcggtgtgcgcacaactggtggaaacccacggtgagccctatggcttgatcaacaacatgggcgtgaccggcgaccagctgttgttcaagttcgacatcgagcgctaccgcgacgtggtcgcgaccaacctcgattcggcagtgtatttcagcaaatgcctggccccggcgatggccgccgagcgccgtggcaagatcctgcacatgtcctccgtcagcgggctcaagggcaacaagggacagatggggtattcggcgaccaaggcggcgatgatcggcatcaccaagaccatggccctggaaatggcgcgcttcaagatcaccgtcaacgccatcgcccctggcttcattgccacggagatggtcgggcagatcgccgacccgatacgcaagtcgatcaccgacaccatccccctcaagcgcttcggcgaagtccgcgaagtggcggccctggccagcttcctgctgtcgccccaggccgactacatcactggccagacattcgtgatcgatggcggtctgacggcctgatcagccgttctgatctggccgcggagccaggagaaataatggggcaagaatacgataccgttttcgtcggcgcgggccttggcgcgttggcgggtgccagccttaaggaagtgctgtcggcgcaatggagctactacggcctgccggccaaggacctggctgagcggcgacttcccagtccaaccagacatttacgagactcaccatgacctacgtagtgaccgacaactgcatccagtgccgccacaccaactgcgtcgatatctgccccgcggatgccttccacctggggccgaacttcatcgtcatcaatccccaggagtgcgtcgactgcggcctgtgcctgcccgaatgtccggaggaagccatccagccggagaaccagctcgatgacagcaaccggcatttcctcgagctcaatgccgagctggccgagcactggccggtgatcctgcagcggattccgcccctggcggaccatgagcaatggagccgcaagccgaacaagctgccccacctgatacatgaggccgaggcggtcgatccgacccgcgaccaccacctggcccatgcctgatgcgcgactggaaccgtaacccatggtggtcgttaccaggtgatggacatcggcacccgcgccgaagcggcggtccgttgacgtctatgctgcggcgcgtgaatcatgggattcattgagaatggactgacatcaaggagcgatggaatgacgaatggatacaacatggcgctggtgatcggcgccgggctcagcctgttggcggcgctgatgcatgtcggggtgatcgtggtcggcccttcctggtatcgcctgtttggcgcaggcgagcgctttgtgcgggcagcccaggccgggcgctggtttcccgcggtggtcacggccgggattgccctggtgcttgccgcctgggcggcgtatgcgctatccgcggccggggtgatcgctcccttgcccttgctgcgcccggcgttaatcgcgatcaccctggtctacctgttgcgtggcctgttggggccggtcgccctggcgggcaccgggcgtagccggcgcttcatctttgtcagctcgacgatctgcctggtctatgggctggtgcatctgttcggcctggtgcaagtgtggggttccctggcctaggggatgctgcagagggctgtggagttgaaagtcagggcccattgcggtcacccttggcaccattagtctggccccagccctttaggacccccatggacatcgcaaaacctgcccttatccgcgaaaccttccctgtcggcccgttgcagtgcaactgcacgatcatcggcgaccctgttacaaaaaaggccatcgtcgtcgacccgggcggcaatcccgacctgatcatggcgcggctcgacgcgctggggctgaaggtggtgagcatcattcatacccatgcccacctggatcacttcctggcctccggacagatgaaggagaaaaccggcgcaaccctgcacctgcacaaggaggatcagttcctctgggacaacctggagatgcagtgcagcatgttcggcgtgccttacacgccggtaccggcaccggatcgctggctggcggacgacgaagagctggcctgcggttgcggcgtggccctgcatacgccgggacataccccaggttccatgagcttctggttcgcagaggctaagctgttgattgccggtgacacgttgttcaagcgcggggtagggcgcacggatctgtgggggggcgaccaggccaccatcgtgcgttcgatcaagcagcgtctgtacaccctcgacgaagacgcgactgtggtggccgggcatggtccggacacccgcctgggcgatgaaatgcgtgaaaatccctttgtcagggcctgacctttgctgtcaaaagtttcacggaatttttgtcattggccgtgttcaaacgcctgcaaaggtctattgccaacgtccgctgcatcacagaatgaaaaaagtaggagcttctccatgttcacctcgcgtcgtttgatcgttgttgctaccgctgtggccttgttgtccggctgtgcttcgcctaacccctatgacaatcaggggcaggccgacggctccacgggcatgagcaaaactgcaaaatacggtggcctgggtgccttggccggtgcgctggccggtgccgccatcgaccacaacaaccgtggcaagggcgcgctgatcggcgccgcggtggtcggtgcttccgccgccggctatggctactacgccgaccagcaggaaaagaaactgcgtgccagcatggccaataccggggtcgaagtgcagcgccagggcgatcagatcaaactgatcatgccgggcaacatcaccttcgccaccgattcggcgaacatcgccccaagcttctatcaaccgctgaacaacctggccaactccctcaaggaattcaaccagaaccagatcgaaatcgtcggctacaccgacagcaccggcagccgccagcacaacatggacctgtcccagcgtcgcgcccagagcgtggcgacctacctgacctcgcaaggggtcagcggtgccaacctgtcggcccgtggcgctggcccggataacccgatcgccagcaacggcgatgtcaatggccgtgcgcagaaccgtcgggtggaagtgaacctcaaggcaattcctggccagcagtatggtggtcagcagcaacagccgggtacggttcagcagtatccgtaactgatcgtttgaatgaaaaaatgcccgatcctgtgatcgggcatttttgtgtgtggcctttgccggcgaagaggtccaatcagtcgctatccaatcaccagatacaaaaaagcccccggacaaccgaatggtccgggggctttttattggacgcgaagcctgattacttcttcagaccataatgctcgtcgagcatgccaggcgcgttaggcgtctttggcgcgtagtcccgtggaggctcctggtcgcgcggtggcgtcaggcgttcccgtggagcctgcaccgagtcggagtgcagcgcggccagcaggcgttggcgggtcaactcgtccagggccaggcggttggcgccctcggcgaggtggtcctgcacttcctgatagctttgagtgagttttttcaccagggtggcggtgctgttgaagtgggtaaccacttcgttctgatagctgtcaaaacgttcctgaatatcatccaactgacgttgcgtgcggttaggcgcggcattcggcagcaggcgagcgaccagaaatccaatggcgacacccgcgatcagggcaagagtcggcaacaaccaaactaagagcgagtgttccacgagtccttcctctataaacggctttgctttacgttaacggctcgaacctgcgctgtataccgcgattcactcgcaatagattggcacagacaatttgctagacgagtcgacccgattcgaggtcacggagttccttccttgcttatgcgtgaaacccccgtagtgattgccggcccggtcggccaactggaagcgctgtatctggatgtcgccgacgcccgtggcgtggcgctgatctgccatccgaacccggtgcagggcggcaccatgctcaacaaggtggtctcgaccctgcaacgtacggcgcgtgacgccggcctgatcactttgcgtttcaactaccgtggcgtcggcgccagcgaaggcagccacgacatgggcagcggtgaagtcgacgacgcgcaggcggctgccgaatggctgcgggccaggcacccggacttgccgatgaccctgctcggcttctccttcggcggcttcgtcgccgccagcctcggcggacgcctggaagcccgcggcgagccgctcaagcacctgttcatggttgccgccgccgtgatgcgtttgcgcgatagcgacctgctgccgcagaactgcccgctgaccctgatccagccggaaaccgacgaagtggtcgacccgcagctggtctacgactggtccgacgcgcttgagcgcccccatgagctgctgaaagtggcagaatgcggacacttttttcatggcaagctcaccgatctcaaggatctggtgctgccacgactctcgaattgattgcagtctgataagcgattacccatgactactcgtacgcgcatcctcaccggcatcaccaccaccggcacgccgcacctgggcaactacgccggcgccatccgcccggcgattctcgccagccgcgacagcaatgccgattcgttctacttcctggccgactatcacgcgctgatcaagtgcgatgacccgctgcgtatccagcgctcgcgcctggaaatcgccgcgacctggctggccggtggcctggatgtggagcgcgtgactttttaccgccagtcggacatcccggaaatcccggaactgacctggttgctgacctgcgtggcggccaagggcctgctcaaccgtgctcacgcctacaaggcttcggtggataaaaacgtcgagaccggcgaagacccggacgccggcatcaccatgggcctgtacagctacccggtgctgatggccgcggacatcctgatgttcaacgcgcacaaggtgccggtcggtcgcgaccagatccagcacgtggaaatggcccgtgatatcggccagcgcttcaaccatctgttcggccagggcaaggagtttttcaccatgcccgaggcgctgatcgaggaaagcgttgccaccttgccgggcctcgatggccgcaagatgtccaagagctacgacaacaccatcccgttgttcagcagcgccaaggacatgaaggacgcgatctcgcgcatcgttaccgactcccgtgctcctggcgaagccaaggacccggacaacgctcacctgttcaccctgttccaggctttcgcgacgccggcccaggccgacgaattccgcagcgagctgctgcagggcctgggttggggcgaggcgaagaatcgtctgttccagctgctggacaaccagttgggcgaggcgcgcgagcgttatcaccagttgatcgagcgtccttcggacctggaagacatcctccaggccggcgccaagaaagcccgcgccgtggccactccattcctcaacgagctgcgcgaggccgtgggcctgcgttcgttcgtcaatcaggtacaagtggcggcgaccaccaagaagaaagcggccaagtccgcgcgcttcgtaagcttccgtgaagacgacggtagcttccgtttccgcctgctggccgccgatggcgagcaactgttgctgtcgcgcaacttcgccgacggcaagaccgcaggtgcggtgaccaagcaactgcaagctggccagactctggatctgcgcagtgaagcgctgggtttcagcgtctggctggaaggtgagtgcgtggccgacagcccggcctttgccgacgcggcggcccgcgatgcggcaatcgatgcgctgcgcgtcgccctgacgcctgtgcaggactaaccgcaatctcccgaccaagggctgattgccattctcaagggccgtcgctacagtgacggcccgtttttgttgccttgctaacgaattatgacgcccctagaacgataccaagctgatctgaaacgcccggagttcttccacgacgccgcgcaggaaaccgccgtgcgtcatttgcagcgcctgtacgacgatctgatcgccgcgtcgaacaacaagccgggcctgctgggcaagctgtttggcaagaaagaccaggtgccggtcaagggcctgtacttctggggcggggtagggcgtggcaagacgtatctggtcgataccttctttgaagccctgccgttcaagcagaaggtccgtactcacttccaccgcttcatgaagcgtgtgcacgaagagatgaagaccctgggcggcgagaagaacccgctgaccatcatcgccaagcgtttcgccgatgaggcccgggtgatctgcttcgacgaattcttcgtttccgacattaccgatgccatgatcctcggcacgctgatggaagagctgttcaagaacggcgtgaccctggtggcgacctcgaacatcgtgccggacggtctgtacaaggacggcctgcaacgtgcgcgtttcctgccggccattgccctgatcaaacagcacaccgagatcgtcaacgtcgacagtggtgtcgactaccgtctgcgtcacctggaacaggccgagttgttccacttcccgctggacgaagcggcccacgaaagcctgcgcaagagcttccgcgcgctgacgccggaatgcacccaggcggtggaaaacgatgtgctgatcgtcgagaaccgcgaaatccgcgccctgcgtacctgcgatgacgtggcctggttcgacttccgtgaactgtgcgatggcccacgcagccagaacgactacatcgaactgggcaagatcttccacgccgtgctggtcagcggtgtcgagcagatgagcgtcgccaccgacgatatcgcccgtcgcttcatcaacatggtcgacgagttctacgaccgcaacgtcaagctgatcatttccgctgaagtcgagctcaaggatctgtacaccggcggccgcctgaccttcgagttccagcgcaccctcagccgtctgctggaaatgcagtcccacgagttcctctcgcgggcgcataagccttaacggtttccagataaaaagaagggcctgcattgcaggccctttttcatttacgcggcttgttggtgaaactgctgtcggtactggttcggtgacagttcggtgtgctggcggaacaggcgggcgaagaagctcgcatcgtcatagccgacctcgtagctgatggtcttgatgctcttgcgcgtccccgagagcaggcctttggcggtttcgatgcgcaggcgctgcaggtaatgcaggggtttgtcgccggtggcggtctggaagcggcgcatgaaattgcgaatgctcatgccatgttcacgggctacgtcctcgaagcggaacttgtcggcgaaatgctcttcgagccagtgctggatctgcaggatgatcacgtcctggtgcagcttctggccgccaaagccgatacgccccggggaatagctgcgctgcacttcatagagaatgtcgcgggccacggcctgggccacgttggcgccgcagaaacgctcgatcaggtagatgtacaggtcacaggccgaagtggtgccgccggcgcaatacaggttgtcggcgtcggtcaggtgcttgtcctgattgagctggaccttggggaagcgctcgctgaaggcattgaagaaacgccagtaagtggtggcttccttgccgtcgagcaacccggcttcggccagccagaacaccccggtggcctcgccgcagagcacggcgccgcgggcatgttgctggcgcagccagggcaggatctgtggataacgttggcagagggtttcgaaatcgtcccagaacgccgggaggatgatcacgtcggtatcttccaggccgccgtccaccggcatgatcacgttgctgaaactgcataccggtttaccatcggggctgaccaggcgggtttcgaaggccggggtcaggccctggcccagctgcttgccgtagcgcaggctggccagatggaagaaatccttggcttgcatgagggtggaggcgaaaacccggtcgatggccaggatgctgacgcgccgcaagggcgtggaggtttggttagacataattcaattgttcttataggggaaagtggtcaccagacggctggatcgtcttattttttgtcggatgtgtccagtgtcctgtgtcgtacgcgtgggcttaggctctgtgggccaatcccggctaacaataacgacaggtggccccatgatccccaggaccttgttcagctccgagcatgagctctttcgtgacagcgtacgtaccttcctggaaaaggaggccgtgccgttccatgggcaatgggaaaaacagggctacatcgaccgcaccttgtggaacaaggccggtgaggcgggaatgctctgctcccatctccccgaggagtacggcggactgggggctgactttctctatagcgcggtagtgatcgaggaggtagggcgccttggtctgactggtatcggcttctccctgcattccgatatcgtcgcgccttacatcctgcattacggcagcgaggagcttaagcacaagtacctgccgaaactggtgtccggcgagatggtcacggccatcgccatgaccgagccgggcgccggctccgacctgcagggggtcaagaccactgcggtgctggacggtgacgactatgtgatcaacggctccaagacctttatcaccaacggctatctggccgatctggtgattgtcgtggccaagaccgatccgaaggccggcgccaagggcaccagcctgttcctggtggaggcggatacgcccggtttttccaagggcaagcgtctggaaaaggtcggcatgaaggcccaggacacttccgagctgttcttccaggatgtccgcgtacccaaggaaaacctgctggggcaggccggaatgggctttgcctacctgatgcaggagttgccgcaggagcgtttgacggtggcggtaggcggtctggcgtcagccgaggcggcattgcagtggaccctggagtacacccgcgagcgcaaggctttcggcaaatcgatcgccgacttccagaacacccgcttcaaactggcggaaatggccaccgagatccagatcggccgggtcttcgtcgaccgctgcctggaattgcatctgcaaggcaagctcgatgtaccgaccgccgccatggccaagtactggggcacggacctgcaatgcaaggtgctcgacgagtgtgtgcagttgcacggcggttacggctttatgtgggagtacccggtggcccgggcctgggcggatgcgcgagtgcagcggatctatgccgggaccaacgagatcatgaaggaaatcatcgcgcgttccctgtagcgcgttgcctcccgcgtagaggcgagcttggtgggccagctcgccttctatgcgtatgcgggagggcaggttacggcgccgggttcgggtggtccttgtggattgcctcgatgccggccagcacctcattcgacagcttcagctcgagactggcgatattgctgtccagttgttcgagggtggtcgcaccaataatgttgctagtgacgaacggttgctgggtgacgaatgccagggccatttgcgccggatccaggccgtgctcgcgggccagggcgacatagcggctgcaggccgcttccgattgcgggttgaagtagcggctgaagcggctgtacaggctcaggcggcccttggccgggcgggcgccgccttcgtatttgccggagaggaagccgaatgccagtggcgaataggccagcaatccacattgttcgcgaatggcgatttccgccaggcccacttcaaagctgcggttgagcaggttgtaggggttctggatcgataccgcccgtggccagccgcggctctcggcgagggccaggaacttcatggtgccccagggcgtttcattggacaggccaatatggcggatcttgccggccttgacctgctcatccagggcttcgagggtttcctccagtggggtgaagtcttcttccttgtgcttgtagcccagttggccgaagaagttggtgctgcgctctggccaatgcaactggtagaggtcgatccagtcggtctgcaggcgcttgaggctggcgtccacggcttggactatgtgcttgcggttgtgtttgagctggttgtcgcggatgtagtcgatggtgttgccggggccggcgatcttgctggcgaggatccagtcggcgcgatcgccgcgagccttgaaccagttaccgatgtagcgctcggtggtggcgtaggtttcggcctttggcggcaccgggtacatctccgcggtgtcgatgaaattgatccctgcagccttggcccgttcgatctgggcgaaggcctcggactcgctgttttgctcgccccaggtcatggttcccaggcagattgcactcacgttcaggtcggtccggcctagctggcgatagtccatcgggtgctccttcggcaaaacaatcataaaagcaggttgaattttttttcgcaatctgcataattccgcagctctttctgcagtggaagtgatgcgccgcctgccgaagaatcttgccgtataacggacgcgctgacccgagcccccgatagcgtctgtatccggctgcctttgacttgtcaaagtacgcactattcagtaagatccgccgtctaatttacagggcggcccctgaggctataaagaatgaaaacttttactgctaaaccggaaacagttaagcgcgactggtttgtcgtcgacgctgctggtcagaccctgggtcgtctggccaccgaaatcgcgagccgtctgcgtggcaagcacaagcctgagtacacccctcacgtcgacaccggtgactacatcgtcgtgatcaacgctgagcaagtacgtgttactggcgctaaaaccactgacaaaatgtactactcccactccggtttcccgggcggcatcaagtcgatcaactttgaaaagctgatcgccaaggcccctgagcgcgtgatcgagaccgcggtaaaaggcatgctgcctaagaacccgctgggtcgcgacatgtaccgtaagctgaaagtctatgcgggcgctgcacaccctcatactgctcagcagccccaagaactgaagatttaacggaatagttcattatgtcggcgactcaaaattacggcactggccgtcgcaagactgcaaccgcacgcgttttcctgcgtccgggcactggcaacatctccatcaacaaccgctccctggataacttcttcggccgcgaaactgcccgcatggtagttcgtcagccgctggaactgaccgagactgtcgagaagttcgacatctacgtcaccgttatcggcggtggtgtgagtggccaagctggcgcaatccgccacggcatcactcgcgctctgatggattacgacgaaactctgcgcagcgctctgcgtaaagccggtttcgtaacccgtgacgcacgtgaagttgaacgtaagaaagttggtctgcgtaaagcgcgtaagcgtccgcagtactcgaagcgttaattcgctttcgcgttcaaaaaacgcccagtctccttgcggagctgggcgtttttttatgggtgattattttgcgctgtgacaacttgccacatctgtagagcccctatactacagggcttggggcagggccaagttggtaattaccttgtcagagtaggggcttttcattaccattcggcaaaatttttataagttcagatttttacttagtagatgcctgatttaacaggccacaaagctgatgggagaggactgaatgagcaatgacggcgtgaatgcaggccggcgtcgcttccttgtagcagccacatccgtggtgggtgctgcaggagcggtgggggctgcggtcccgttcgtggggtcatggtttcccagtgccaaggcgaaagccgcaggggcaccggtgaaagtgaatatcagcaagatcgacccaggtcagcagatgattgctgagtggcgtggtcagccggtattcatcgtccgccgcacacaggaaatcctggggaatctcaaaaagatcgagggtcaactttccgatcccgactccaagaactctgtccaaccaacctacgtcgacccacaagtgcgttcgatcaagccagagattctgctgctgatcggtatctgcacccacctgggttgctcaccgactttccgccctgaagtggcgcctgcggatctgggcaaggattgggtagggggctatttctgcccttgccacggttcccactacgatctggctggccgcgtctacaagtcgcaacccgcgcctttgaacctgccagtacccccgcattcctatgagtcggacgaccttattgtcatcggcgtcgatacggagaaagcgtgatgagcaagttcatggattgggttgatgcgcgcttccccgcgaccaaaatgtgggaagaccatctcagcaagtattacgccccgaagaacttcaacttcttctacttctttggttccctggctctgttggttctggttaaccagatcgtcaccggtgtctggctgaccatgagctacaccccgtcggcggaagaggctttcgcttccgtcgaatacatcatgcgcgacgtcgagtacggctcgatcctgcgtctgctgcactccactggcgcctcggcgttcttcatcgtggtctatctgcacatgttccgtggcctgctctacggttcctaccagaagccgcgtgagctggtgtggctgttcggcatgctgatctacctggcgctgatggccgaagccttcatgggctacctgctgccttgggggcaaatgtcctattggggcgcccaggtgatcatctcgttgtttggtgcgatcccggtcatcggtaacgacctgacccagtggattcgtggtgactacctgatttccggtattaccctgaaccgcttcttcgccttgcacgtagtggccctgccaatcgtgattctcggtctggtggtgctgcacatcctggcgctgcacgaagtcggttcgaacaacccggatggtgtggacatcaagaagcacaaagacgaaaacggcgtaccgctggatggcatcgctttccacccgtactacaccgtgaaagacatcgtcggtgtggtggtgttcctgttcatcttctgctcgattgtgttcttcttcccggaaatggggggttatttccttgagaagccgaacttcgaacaggccaacccgttcaagacgcctgagcatattgccccggtttggtacttcaccccgttctacgcgattctgcgcgcggttccggacaagctcttgggtgtcattgcgatgggcgcggcgatcgccgtgctgttcgtgctgccatggcttgaccgcagtccggtcaaatccatgcgctacaagggctggctgagcaagatctggctggtggtgttctgcatctcgttcgtgatcctggggatcctcggcgttctggcgccgacgccgggtcgtacgctgctgtcgcaggtatgtaccttcctgtacttcgcctacttcattctgatgccgttctacaccaggctcgagaagaccaaaccggttccggaaagggtgactggctgatgaaaaagctatttgctgtactgattcttgctgctatgcctgtactgtcctttgcggccgaacacggtggtcccgagctggaaaaagtcgacatcgacgtctccgacaaggccgccatgcaggatggcgcacggacattcgccaactactgcatgggctgtcacagcgccaagttccaacgctatgagcgcgttgccgacgatctggggattcctcacgatctgatgatgagcaagctggtgttcaccggtgcgaaaatcggcgatcacatgagcatcggcatgcagccggctgatgccaagacctggttcggcgcggctccgcccgacctgaccctggtggctcgtgtgcgtggtaccgactggctctatggctacctgcgctccttctacgaagaccctgcgcgtccatggggcgtgaacaacaaggtcttcccgaacgtaggtatgcctaacgtcctggtcggcctgcagggtcgccaggttgttggctgcaaacaggtgcagatcgtcgaagacggcaagaagcaatacgatccgctgaccggtaccgctttgacccatgaagcttgcgaccagctgaccgtgctgccaaaaaccggcacgctcaacgaagagcagttcgacgagaaggtcaagaacctggtgaccttcctggcctactcggccaacccggtcaagctggagcatcaacgtatcggcacctatgtgttactgtatctggccttcttcttcgtattcgcctatctgctcaagcgcgaatactggaaagacgttcattgataaagctgtaattcattgctgttaatcgtgcgcgcccaagggcgtctctgaaggtgtaacgagtctggatcatccaggcgttacgggaggcgccctctgggcgcgctcgtttttctgcttccgataatttcaacaagcgaggaggaccgccatgggcgtgaccaatcggttggcctgttactccgaccccgccgaccactattcccaccgggtacgtatcgtgctcgcagagaagggtgtcagcgccgagatcatcagtgtggaggcggggcgtcagccgccgaagctgatcgaagtgaacccttacggcagtctgcccaccctggtcgatcgtgacctggcgttgtgggagtcgaccgtggtgatggaatatctggatgagcgttacccgcacccgccactactgccggtttaccctgtggcgcgtgccaacagccgtctgctgatccaccggatccagcgtgactggtgtgggctggtggatctgatcctggattcccggaccaaggaagccgctcgggctcaggctcgcaaagagctgcgcgagagcctgaccggcgtttcgccgctgttcgcggagaagccgtttttcctcagtgaggaacaaagtctggtggattgctgcctattaccaatactctggaggctaccgatcctgggtattgaattgccacggcaagccaagccgttgcttgattacatggagcgccagttcgcccgtgagacgttccaggcaagtctgtctggcgtcgaacgcgacatgcgctaaggcttaaggagccgctatgaactccagtcgaccttatctggtccgcgcgctctacgagtggattgtggacaacgattgcaccccgcatatgctggtcaattccgaatacccggcggtgcaggtgcctcagggtttcgccagtgacggacagatcgtcctgaatatttcgccgagtgccgtgcgccatttgcatatggataacgaggtggtgactttcgaagggcgctttggtggcgtcccgcatagcttgtacgtccctgtgccggcgatcctgggcatttacgcccgggagaatggtcagggcatggtgttcgatctggagtcgcccgtggatgatgaggacgatgaaatcgagccggatgatgatattccaccaccggatagcgagccgccgcgtccaagcggtcggcccagtctgaaggtcgtgaagtaataaaaaaggcgatccggatggatcgccttttttgtgcctgtacctttcgttcacatcagtcgatgtattcaaacagtttgacgattttctgcacgccggaaacgccctgtaccagattggtcgcctgggtggcttcctgttgggtcagcaggcccagtaggtagacgatgccgttttccgtcacaaccttgatgcgcgagcccggaatgctggcatcggtcagcatctgggtcttgatcttggtggtcagccaggcatcgttctgccgggccagcagggaagagggtggcagaacctgcagttcgttgtggaccttcttcacccgttgcacggcgctggcggcctgctcggcgagtgtcttgaggtcggcacgcggggtctggccggccagcaggacgataccgttgaagctggtcaccacgatgtgcgaattgtggtccaggtccggactggccttggcgacgttcacttcgactttggtctggatcagtgagtcatcgatcttgctgccgaaggtgcgggtgccacggtcatcttcgatcgggctttcgcgggtggcggtaatcaccgagctgcaaccgctgatgctcaaggctagggtcagggccagtaggccaaggcgattaggggtcattcttcactcccgaacagttggctgtcgatcaggtcgcagaggcagtggatcgccagcaggtggacttcctggatacgtgcagtgacattggccggtacgcgaatctcgacatcttccggcaataacagggatgccatgccgccgccatcgcgaccggtcaatgctacgacaatcatttctcgatcatgtgcggcctggatcgcttgaataatgttcgccgagttgccgctggtggagatcgccagcaggacatcgccgggctggcccagggcgcgaatctgcttggaaaagacttcgttgtaactgtagtcgttggcgatcgaggtgatcgtcgagctgtcggtggtcagcgcaatggctggcaggctcgggcgctcgcgctcgaaacggttgagcagctcggaagagaagtgctgggcatcgccggccgagccgccgttgccacaggaaagcattttcccttcgttgagcagggcgttgaccatgacctggctggcttgctcgatgtgcggtgcaagtacgtccatcgcctgttgcttggtgtcgatactggcctgaaaaagctggcgaattcgggattgcatgtccatctgtgtgaccttaagtggcgcggctttctggcacatgaatgtgctgcccgcaaagcaaagagcaaaaatgttgagtgaaaatgtccggctcggcccgagagcgtcgatcagctttcaaaggcattccgtagccagttcaaatgagtggtcgtgcctggggcgctgtctatggcgaccacgtcgaaacggcaagggtggttggaccagcgcgactcgcgctgcaggaaaaactgtgcggcgagtatcagtttctgacgcttgcgtgcgtcgatactgcccagtgcgccaccccattgcgtgtgttgtctgtagcggacttcgacgaatactactgtatcgccgtcaagcatgaccagatcaagctcgccgcgtttgcacaaccagttctgcgccaacaggcgcagcccttgttgttcaagatgccggagcgcttgggcttcggcatcctgaccgctttgctggcgtgatcgttgtggcattagcgctgggtgtcaggcaggcgagtgatctggccgctgacgaactcggcccatggcagctggcgttgaacacgctggctcgggctcatggtcaggctgcccgacaggccttcgatgcggctgtccggcagggtcttgagttgccccaggcgtggtgccaggcggtaggcgtcggcgcccatcgcatacagtcgacccaggctgccaccagcttgtggccattgcgcggcgacttgccggcgcagcgggtcattggcatccagcagccaaggcgtttcgcagaagcgtatgccgttcatgtcgttgtactggttctggtcgccgctggcgctgaaaacatgggaggtggcatagacaggtacatcgccggcgtactgaaagttcagggtcggcttgatctgttgtgcctgttgcggagtggacgcgaggaaaatgaactcgatgtcctggcgacgcgaaggttgcgcggccacttgagtgccggcggcattctgcaggctcttggcgcgggcttcgctctggcgcagttggaacaggtcggcaatctgctgggccagggctaccggctgatcgacgcgttcgataccgaccacactaccgccattgctttcccagtcctgacggaaagccttgagcacacgatcaccccattcgccgtgcggcaccaggaccgcggcgcggtgcaggccgtcggcgcgggcgcggcgggagacttcgcgagcttcgtcttcggcggccaggccgaactggaacagttgtgcggggccttgttcgccttcgctgtagttcagcgccagggtggtgataggcagttgcgggcgcgcggcgagctgtttgaccagtggtttttccagtgggccgacgaccagttgcacgccatctgcctgggccttgcgatagaagtcatccagcgaagtcaggcgcgagctgtcatagaactcgatgctgggtggtttctggccggcttgctgggcctgatagtgcgcggccatgaagccatcgcgcagggccttggagaccgcggccagcgggccgtcctgcggcaacagcagggcgatcttggacagcggctggctggccagttccttgagtttggtcagcggcagcggcagctgaatggccgccggatgcttggggttctgtgcgcgccagttgtcgatggcggcctgctgttgttccagggtgccggcggtcttcactgccagcgccaggctcatccagccgcccaggtcatcgttgccgacggcttgcagttgatcagtcggcaggctggcaatcaacgcccagatggcttcgtggttcttgctcgcggtgtcgtccttgagcagtggcgcaatgaaaatgcgctcccgtgccgcagcgagggcctggccgtcagcctctagtgcgcgagcgtggacagtgccggtgcggatttgctgctcttccggcagttcgctcaggcgttgcaggctcgggtggctcagggcagtcagggcggcctttggctggttgcgagtcatggccagctcggcggccagggtgctggcgaaaacctgctggccgggcttgagttgctccatcggcacttgttgcaggatttgcgcggcctggccggcgttgccctggcgataggccaggtcggcagcgctcaagcgcagcagggctgccttgtcgggtgttttgctgttggcggcctgttcgagcagttgctcgatgctggcatccggggtccgtggaagttcgccaaggctggaggagggcgagctggcgcaagctgccaggagggcagcaaggcataaggcagagaacagccgcaggcaagcgatcatgtaagtgttcctgatactcgatcaaattagcgtggaattgtacccaagcactggccggggcgcgatgttactggcaataaaccgtctattttaggtcgagcaaatgttgcagtgctttagagcggctggcgctgtccctggcgtgaggtgcctgcgacacgcattccgaaggcttctacgcgctacaatggcgcttttaccgatcaagaggtgtgcgctttgactgctccaggtcctttgaattccgctgctggctcgctttatgtggtggcgacgcccatcggcaacctggacgacatcagtgcccgggccttgaagatcttgcgtgaggtggcgctgatcgccgccgaagacacgcgccactcgcaacgcttgatgcagcacttcgggatttccacaccgctggccgcctgtcatgaacataacgaacgggatgaaggcagccgttttctgacccgtctgttggcgggagacagcgttgcgctgatttccgatgcgggcacgccgttgatctccgatccgggttaccacctggtgcgtcaggcgcgtgcggcgggtatcaatgtcgttcctgttcctggggcttgcgctctgattgcggccttgtcggcggcggggttgccttccgatcgttttatcttcgagggctttttgccggccaaggcggtaggacggcgcgggcgccttgagctattaaaggaagagccgcgcacgctgattttctatgaggcgccacaccgtattctcgagtgcttgcaggatatggagtcggtgttcggtggcgagcgtccggcattgctggcccgggagctgaccaagacctttgaaaccctcaaggggctgccgctttcggagttgcgggctttcgtcgaggcagacagcaatcagcagcgcggcgaatgcgtggtgctggtagagggatggtcagcaccggagagcgacgaggctgtgagcagtgaggcgatgcgggttctcgacctgctgctcaaagagatgccgctcaagcgtgccgcggcattggcggcggaaattaccggcgtgcgcaagaatgtgctctatcaagtggcgctggataaacagaaaggcgagtaaacgcgatcggcggaatggcaaagggcttttatcacttgttcttccgccgctctgccgttaacctgcgcggcggagagtcgattggacagtcgctgccctctatgaaaattagaggggggaggaaagtccgggctccatagggcggagtgccaggtaatgcctgggaggcgcgagcctacggaaagtgccacagaaaataaccgcctaagcacttcggtgccggtaagggtgaaaaggtgcggtaagagcgcaccgcacgtctggcaacagttcgtggctaggtaaaccccactcggagcaagaccaaatagggttccaaggcgtggcccgcgctggaaccgggtaggttgctaaagatgtccagtgatggccatcgtagaggaatgactgtcctcgacagaacccggcttacagatcgactctccaccttttccctccctgcttgaatcaatagcagaagcgcttttgtaataccgaaaagatcttactcttaacaaattactttaacttcgcgatacagcttcttgagctgattgaagttattgcgccaaatccttcgccaaattcccgttacccctccttttagtctcctaaatctccgttctataaggcttttccgtcgttccgtgccttgacggtgtggtgggcgcattcctatagtgtgcgcaagtggcggaaagtggcatgaagtgggttttttggacgtaaaacgctaaaatttggagaaacgctgacgtgtttcgcggagctaacgctatcagtctcgacgcaaagggccgtctcgccatgccgagccggtaccgtgacgagctcgtttcgcgtagttccgggcaacttatcgtcactattgatgccgttgatccgtgtttgtgtgtctaccccctcgatgagtgggaaattattgaaaccaagctgcgcgcgctgccttcgctacgtgaagaaaaccgtcgcttgcagcgtttgctgattggtaatgccgtcgacctcgaactcgatggcagtggtcgttttctggttccgccgcgtctgcgcgaatatgccaagttggataagcgcgcaatgttggtaggccaactgaacaagttccaactgtgggacgaggatgcctggaatgctgtttccgcagcggacctggcggctattcaacaaccgggcgccatgcctgatgaactgcgtgatttgatcctgtgactattgatagcggctttaaccacatcaccgtgctgcttgacgaagccgtcgaggctctcgccgtacgtcctgatggctgctatctggatggcaccttcggtcgcggtggtcatagtcgtctgatcctcagcaagctcgggccggatggccggctgctcggattcgacaaagatcctcaagcgattgccaccgggcaagcgctagcggccgaagacggccgctttgtcgttgtgcagcgcagctttgccgagctgggttcggaagtggccgagcgcggcctggatggcaaggtcagcggcgtgctgctcgacctgggtgtgtcttcgccgcagctcgacgatcctgagcgcggcttcagttttctcaatgatggtcccctggatatgcgcatggacccgtcccgcggcatcagcgcggcggagttcgtcaacaccgcgccggtggaagaaatcgcccgtgtattcaaggaatacggcgaagagcgtttctccggtcgcatggcccgcgccgtggctgagcgccgcgacatcaagccgttcgagcgcaccgccgacctggcggaagtcttgaaagtcgccaacccggcctgggaaaagggcaagaacccggcaacccgtgcgttccaagggctgcgcattcatgtcaacaacgaactgggcgatctggaagcaggcctcgaagccgcgctggaatgcctggaggtcggtggccgtctggtggtcatcagtttccactcgctggaagaccgcatcgtcaaattgttcatgcgcaagctggtgaagggcgaggcggacaacctgcctcgcaacctgccggtgcgccacgtggctttcgagccgaaaatcaaagtccatggcaaagcgcagacggcctccgatgccgagctcaaggccaacccgcgtgcccgtagtgctgtcatgcgcgttgcggagaagctgcggtgagcaagcttttcgccaagccacttccaggcggaagctttttcatgcttctgctgttcatcggcgtcctggtatccgcgattgcggtgtcctatagcgcccactggaatcgccaactgctcaacacgctgtacggcgagttgagtgtgcgtgacaaggcacaagcggagtggggccggctgattctcgaacaaagcacctggaccgcccatagccggatcgaagtgctggccaccgaacagctgaaaatgcgcattcccggcgcggcagaagtccagatggtagcgccatgatgaagcttgaaggcgcactcttcccctggcggttccgcctggtgctgggcttgctcggcatcatggtggcggcgatcgcctggcgcatcatcgatctgcaggtcgtcgatcgcgacttcctcaaggggcagggcgatgcgcgcagcgttcggcatatcccgatcccggctcaccgtggcttgatcaccgaccgtaacggcgagccgctggcagtcagtacgccagtgaccaccttgtgggccaacgccaaggaaatgcagctggccaaggacaagtggccggcattggctgcggccttggggcaagatcccaaggcgctggccgagcgccttgaagcgcaagccaataaagaattcatctacctggtgcgcggcctgacgcccgagcagggccagcaagttctcgatctcaaggtgccaggggtgtatggcatcgaagagttccggcgcttctacccggccggcgaggttaccgcgcacatggtcggctttaccgacattgacgatcgcggccgcgaaggggtcgaactggcttatgacgagtggctcgccggagttccgggcaagcgccaggtcatcaaggaccggcgcggcagactgatcaaggatgtccaggtcaccaaaaacgccaaggccggcaagcccttggcgttgtcgattgacctgcgcctgcaatacctggccaaccgcgaactgcgcaatgccatcgtcgagaacggcgccaaggccggcagcctggtcatcatggacgtgaagaccggcgagatcctggccatggtcaaccagccgacctacaacccgaacaaccgtcgcaacctgcaaccggcgatgatgcgtaaccgcgccatgatcgacgtgttcgagccgggttcgaccatgaaagccatctccatgagcgcggcgctggaaaccggccgctggaaaccgagcgacaccgtcgaggtttatccaggcacgttgcagatcggcaagtacaccattcgcgacgtctccaagagtgaaggtgcggtactcgacctgaccgggattttgatcaattccagtaacgtcggcatgagcaagatcgccttcgatatcggtggcgaagccatcttccgcctggcccagaaaatcggtctcggccaggacaccggcctcggcttcccgggcgagcgagtcggcaacctgccgaactaccgcgagtggcgcaaggccgagacagccacgctgtcgtacggctacggcatctcggtgaccgcgatccagctggttcacgccttctcggccctggccaacaacggtcgcattgcaccgctgactctgatcaaaaccgacaagaccccggaaaccacccaggtgattccggaaaaagtcgccaagaccatgcagggcatgttgcagcaggtgatcgaggcgccgcgtggcgtgttccgtgcccaggtgccggcttatcacgtggcaggcaagagtggtaccgcgcgtaagacttcggtcggtaccaagggttatgccgagaactcctaccgctcgctgttcgccggtttcggcccgatgagcgatccgcgctacgccatagtcgtggtgatcgacgagccgagcaaggccggttacttcggtggtctggtatcggcgccggtgttcagcaaagtgatgtccggcaccctgcgtctgatgaatatctcgccggacaacctgccacctacccaacaagccaatgcggcaccagctaaaggagggcgcggctgatgtctcttagcctgaacaagattttcgcccacgctggtcgtgatctgctgattcgcgaactgaccctggacagccgcaatgtgcgtgccggcgatctgtttcttgcggttcctggcggcaagttcgatggtcgtgcgcacatcgccgatgccttgcagcgcggtgcggctgccgtggcttatgaagtcgaaggcgcgaccgtcctgccgattaccgacgtgccgctgattccggtcaaaggcctggcggcgcagttgtcggatatcgccgggcgtttttatggcgatccgagccgcaacctcaacctgatcggggtgaccggtaccaacggcaagaccagcgtgacccagctggtggcgcaggcactcgatctgctgggccagcactgcggcattgtcggcaccctcggcagcggtttttatggcgcgctgcaaagcggcatgcataccacgccgaacccgattgccgtgcaggccaccctggccgacctgaaaaaggccggcgccaaggccgtggcgatggaagtgtcgtctcatggtctcgatcaagggcgggtcagtgctctggccttcgacgtggcggtgctgaccaatctgtctcgcgaccatctggattatcacggcaccatggaagcctacggctccaccaaggccaagctgttcggctggaccgatctggggtgccgtgtcatcaacctcgacgatgagttcggtcggctgctggccagtgacgaacaggattcgcggctgattacctacagtctcgaggatccacgggcctatctgtactgccgcgaagcgcaattcgacgacgaaggcgtgcgtgcaaccctggtgactccgcagggcgagcatcatctgcgtagcaccttgctcggtcgtttcaacctgagcaacgtgctggccgctgtcggcgccttgctcggcctggattacgccctcgacgaaatccttaacgtactgccgaaactggaaggcccggccggtcgcatgcagcgcctgggtggtggttcgcaaccgctggtggtggtcgattacgcccacaccccggatgccctggaaaaggtactgctggccctgcgtccccatgccaagggccgtttgctgtgcctgttcggctgtggcggcgatcgcgatcgcggcaagcgtccgctgatggcggaagtggtcgagcgcctggccgatggcgttctggtcaccgacgacaacccgcgcacggaagatccggcgcagattttcgacgacattcgtgccggcttcagggccgtggacaaggtcgagttcgtttccggtcgcggcctggccatcgcccagttggtcgccggcgcttcggcggacgacgtgattgtcctggccggcaaaggtcatgaggactatcaggaaatcaatggcgtgcgtctcgacttctccgacctggtggaagccgatcgagcgctgaccgcgtgggaggtggcccatgcttaaggccctgaaactcagtgaactgagtggaccgctggcgggtcgcctgctggctggcgattgcagcttcgatggcgtgagtatcgacagccgggcgatcaagccgggccagctctttattgccctggccggcccacgtttcgacgggcacgactacctgaatgaagtcgccgccaaaggcgccgtcggggccctggtcgaacgcgaagtgccagacagcacgctgccgcagttgctggtcagcgatacccggcaggccctcggccaactgggggcgttgaatcgcgcggctttcaccaagccggtagcggcgattaccggctccagcggcaagaccacagtcaaggaaatgctggccagcatcctgcgtacgcgtgggccggtgctcgccacgcgcggcaacctgaacaatgacctgggcgcgcccttgaccctgctggaactggccccggagcacaccgcggcggtgatcgagctgggggcttcgcgcatcggcgaaattgcctacaccgtggcgatgaccaagccgcaggtcgccatcatcaataatgccggtaccgcccatgtgggcgagtttggcgggccggaaaaaatcgtcgaggccaagggcgagatccttgaagggctggatgcttccggtaccgctgtgctcaatctcgacgacaaggccttcccgatctggaaagcccgcgctgctggccgtcaggtgctgagttttgccctgaccaacaatgccgccgacttttacgcctcggatatccagcgcgatgcccgtggctgcccgaacttcaccctgcacgcgggcaacggttccgagcgcgtccagttgaacctgctgggtacccataatgttgccaatgccctggccgctgcggctgccgcgcatgccctgggcgtgtcgttgttcggcatcgccaccgggctcaacgcggtgcagccggtcaagggccgcactgtcgcccagctggcgaaaaacggtatgcgggtaatcgacgacacctataacgcaaaccccacatcaatgtgcgcggccgttgatatactcgccggcttttccggtcgcaccgtcctggtgctcggagatatcggcgagttgggcgattgggcggagcaggggcaccgcgaagtgggtgcttatgccgccggcaaggtatcggcgctctatgccgtgggcccgatgatggcccatgcagtcgccgccttcggtgagcacgcccgacacttcgccagccaggccgagctgattgcagccctgggcgccgagcaagatacaaacaccactattttgatcaagggatcgcgcagcgcggtgatggaaaacatcgtcgcggctttgtgtggttccagcacggagaaacattgatgctgctgctgctagcggagtacctgcaacagttctacaaaggcttcgcggtctttcagtacctgaccctgcgcgggattctcggggtactgactgcactggtgctgtccttgtggctggggccgtggatgatccgcactctgcagacccgtcagatcggccaggccgtgcgtaacgacggtccgcaatcgcacctctccaagtcgggtactccgaccatgggcggcgcgttgattctttcggcaatcggtatcagcaccctgctgtgggccgacctgagcaaccgttatgtgtgggtggtgttgctggtcaccctgctgttcggcgccatcggctgggtcgatgactatcgcaaggtgatcgagaagaactcccgtggtctgccgagccgctggaagtacttctggcagtctgtatttggcctgggcgcggcgatcttcctctatgtcaccgcgcaaaccccggtcgaaaccaccttgctgatccccatgctcaaggacgtcagcattccgctgggcattggcttcgtggtcctgacctatttcgtgatcgtcggctccagtaacgcggtcaacctgaccgatggcctcgacggcctggcgatcatgccgaccgtgatggtaggcggcgccctgggcatcttctgctacctgtcgggtaacgtgaaattcgctgagtacctgctgattccttacgttccgggcgcgggtgaactgatcgtgttctgcggcgcgctgatcggcgccgggctcggtttcttgtggttcaacacctacccggcacaagtcttcatgggcgacgtcggcgcgctggcgctgggcgcggccctgggcaccatcgcggtgatcgttcgccaggaaatcgtcctgttcatcatgggcggcgtgttcgtgatggaaaccctgtcggtggtcattcaggtggcctccttcaaattgaccggtcgtcgtgtctttcgcatggcgccgattcaccaccactttgaactcaagggctggcccgagccgcgtgtgatcgtccgtttctggatcatcaccgtgattctcgtgctgatcggccttgccaccctgaagctgaggtagaacgagtgtctctgatcgcttctgaccacttccgcatcgttgtcggcctcggcaagagcggcatgtccctggttcgcttcctggcgaaccggggcgtgtcgtttgccgtcgccgatacgcgggaaaatccaccggaactggccacgctgcgccgtgactatccgcatgtggaagtgcgttgtggcgagctggacgtcgacttcctgtgccgcgccgacgagctctacgtgagccccggcctggccctggcgaccccggccctgcaagccgccgccgcccgtggggtgaaactctccggcgatatcgagctgttcgcgcgtaacgcgaaggcgccgatcgtcgccatcagcggctccaacgcgaaaagcaccgtgaccaccctggtgggggaaatggccgcggcggcgggcaagcgggtcgccgtgggcggcaacctgggtacgccggccctggacctgctcagcgacgacgtcgagctgtatgtcatggaactgtccagcttccagctggaaaccaccgaccagttgggggccgaagtggccaccgtgctgaacatcagcgaagaccatatggaccgctacagcggcctgccggcgtatcacctggccaagcaccggatcttccgtggcgcccggcaagtggtgttcaaccgccaggatgccctgacccggccattgatcggcgaaggcctgccgtgctggaccttcggcctgagcaaacccgatttcaaggcgttcggcctgcgtgaagagaatggcgagaaatacctggccttcgaattccagaacctgatgccggtgcgcgagctgaagattcgtggcgcccataaccagtccaacgccctggcggcgctggccctggggcatgcggtcggcctgccgttcgatgccatgctctcggccctgcgcaccttcgctggcctcgagcaccgctgccagtgggttcgcgacctggatggagtgggttattacaacgattccaaggccaccaacgtgggcgccgcactggcggccatcgaaggcctgggcgcggatatcgaaggcaagatcgtgctgatcgccggtggcgacggcaagggtgccgagttcaaggacttgcgcgatccggtggcggccaactgccgcgccgtgatcctgatgggccgcgattccgacaagatcggcgaggccatcggcgatgccgtgcagctgattcgtgtcggctccctggtcgacgccgtggcgcaatgccgtgccgccgcccagtccggcgacgtggtgctgctgtcgcctgcctgcgccagtttcgacatgttcaagaattacgaagaccgtggtcaccagttcgtccgcgccgtggaggatctggcatgaacctgagagacatcatcaagccttatccatcgccgatcatcaccgggcgcggcgtcgacctcgacttcccgatgctcgccggctgcctgacgctgctcggcctcgggttgatcatgatcgcctcggcctccaccgaagtggcggcggtgcaatcgggcagcgccctgtattacatgattcgccacctgatctacgtggtgctgggcctgggtgcctgcatcgtcaccatgatgattccgatcgccacctggcaacgcctgggctggatgatgctgctcggtgccttcggtttgctggtgatggtgatcatcccggggatcggccgcgaggtgaacggttcgatgcgctggatcggcttcagtttcttcaacgtccagccttccgagatcgccaaggtgttcgtggtgatctacctcgccggttatctggtgcgtcgccagaaagaagtgcgcgaaagctggatgggcttcttcaagccattcatcgtgctgttgccgatggctggcctgctgctgatggagccggacttcggcgccaccgtggtgatgatgggggccgcggcggcgatgctgttcctcggcggggtcgggctgttccgtttctccttgatggtggtcctggcggtcgcggcggtggtcctgctgattcagatgcagccctatcgaatggcgcgcctgaccaactttgccgacccctgggccgaccagttcggcgcgggctaccagttgtcccaggccttgatcgctttcggtcgtggcgaatggctgggcgttggcctgggcaatagcgtgcagaagcagttctacctgccggaagcccacaccgacttcgtgttctcggtcctggccgaagagctgggcgccgtgggttccctgtgcacggtggcgttgttcgtcttcgtctgtatccgtggcatgtacatcggcctgtgggccgagaaagccaagcagttctttgccgcctatgtcgcttatggcctgtcgttcctgtggatcggccagttcctgatcaacatcggggtgaacgtcggcctgctaccgaccaaaggcctgaccttgccgttcctcagttatggcggcagttcgttggtgatctgctgcgcctgtcttggcctgttgctgcgcatcgagtgggagagtcggacccacctgggcagcgaagagatggagttcagcgagagcgacttcgccgaggagccaagccatgggcgctaacgtgctgatcatggccggtggcaccggcggtcacgtgttcccggcgctggcctgtgcccgcgaattccaggcgcgcggttataccgtgcactggctcggcaccccgcgcggcatcgaaaacgagttggtgccgaatgccggcctgcagctgcacctgatcaacgtcagcggcctgcggggcaagagcaagctgtcgctgctcaaggcgccattcgtgctgctcaaggcggtgttgcaggcgcgccggatcattcgtcagctcaagccggtctgcgtgctgggctttggcggttatgtgaccgggcctggtggcgtcgcggcaaaactgtccggcgtgccggtgatcattcatgaacagaacgcggtcgccggtaccgccaatcggctgctggtgccgttgtcggcccgagtctgcgaagctttcccggacacctttggtgcctccagcagccggcgtaccaccggcaacccggtgcgcaccgagctgttcctcgatacaccgcgcgaggccctggccggacgcaaggcgcgtttgctggtcctgggtggaagcctgggagcagagccgttgaacaagttgctgcctgaagccctggcgctggtctcccccgagctgcgtccggaagtgtttcatcaggccggcaaaaaccacgatgaagtgactgcagagcgctatcgcgccgccggcgtcgaggcgcaggtgcagccgttcatcaaagacatggcccaagcctacggctgggctgacctggtggtctgtcgcgcaggcgcgttgaccgtcagtgaactggctgccgccggtctgccttcgatgctcgtgcctttgcctcacgccatcgacgatcaccagacccgcaatgccgattatttggctcgtgaaggcgctgccttcctgatgccgcaaagaacgactggcgcagcggaccttgccgctcgcctgacagaggttttgatgcaaccggaacgactcaacagcatggccgacgccgcacgtcgcctggccaaacccgatgccacccgtagcgtggtcgatatctgcctggaggtggcccatggttgagaatcagaaagccatgccacaaccggaaatgcgccgtatccgtcgcatccacttcgtcggtatcggtggcgtgggcatgtgcgggatcgccgaagtactgctgaacctgggctaccaggtttccggctccgacctcaaggcgtcgccggtcaccgagcgcctcgagtcctttggtgcgcagatcttcatcggccaccgtgccgagaacgccgccaacgccgatgtactggtggtgtccagcgccgtgaacacctccaacccggaagtggccaccgccctggaacgccgcatcccggtcgtgccgcgcgcggaaatgctcgccgagctgatgcgctaccgccacggcgtcgccgttgccggtacccacggcaagaccaccaccaccagcctgctggcctcggtgttcgccgccggtggcctggacccgacctttgtcatcggtggccggctgaatgcagctgggaccaatgcacagttgggcaccagccgctacctgatcgccgaagccgatgaaagcgacgccagcttcctgcacctgcagccgctggtagccgtggtgaccaacatcgacgccgaccacatggcgacctacgacggtgacttcaacaagctgaagaaaaccttcgtcgaattcctgcacaacctgccgttctatggcctggccgtgctgtgcctggacgacccggtggtgcgcgagatcctgccgcaggtcaagcgtccgaccgtcacctacggtttcaacgaaggcgccgacgtgcgcgcgatcaatgtacgccagcagggcatgcagaccttcttcaccgtgctgcgtcccgatcgcgagccgttggatgtctcggtcaacatgccgggcaaccacaacgtgctgaacgcgctggcgaccatctgcatcgccaccgacgaaggcatcagcgatgaagccatcgtccagggcctgtcgggcttccagggcgtgggacgtcgcttccaggtctacggcgaactgccggtggacggcggcaacgtgatgctggtggacgattacggccaccacccgaccgaggtcgcggcggtgatcaaggccgtgcgcggtggctggcctgagcgccgcctggtgatggtctaccagccgcaccgtttcagccgcacccgcgacctgtacgacgatttcgtccaggtgctggcggacgccaacgtcctgctgttgatggaagtctatccggcgggcgaagagccgatcccgggggcggacagccgtcagctgtgccacagcatccgtcagcgcggtcagctggacccgatctacatcgagcgtggggtcgaccttgcgccgctggtcaagccgctgctgcgtgccggcgacatcctgctgtgccagggcgccggtgatatcggcggccttgcgccgaagctgttgaacagtccgttgtttgcgggtgccgtgcctgccggtcaggggaagtcgaaatgaccgccgcctacgcctctttgttttcgaccctcgcgccgaaggatttcggtcgcgtcgccgtgctgttcggcggcaagagcgccgagcgcgaagtctcgctgaagtccggcaacgccgtgctcgaagccttgctgagcgccggtgtggacgccttcggcatcgacgtcggtgacgacttcctgcagcgcctgctgaacgagaagatcgatcgcgccttcatcatcctccacggtcgtggcggcgaagacggcagcatgcagggcctgctggaatgcatgggcattccctacaccggtagcggcatcctggcttcggcgctggcgatggacaaactgcgtaccaagcaggtctggcacagcctcggtattccgacgccacgccacgccgtacttggctccgaggccgattgtatttccgcagctacggaactgggcatgcctttgatcgtcaaaccggcgcatgaaggttccagtattggtatggccaaagtgacatccgcgtccgaactgatcgacgcatggaaagcggccagcacctacgactcgcaagtcttggttgaacaatggattcaaggtccggagttcaccatcgccacgctgcgcggccaggtattgccaccgatcgccctgggcacgccccacacgttttacgactacgacgccaagtacctggcttccgatacccagtaccggattccgtgcggcctcgacagcaataaagagcaggagctcatggacctcacggcgaaagcctgcggggcgctcggtatcgccggttgggcgcgtgccgacgtgatgcaggacgccgatggccagttctggttcctggaagtgaataccgctcccggcatgaccgatcacagcctggttccgatggcggcccgtgccgccggtctggatttccagcagttggttctggccatcctggcggagagtgtcgtcagtaacgcagagccgcgaggttaaggccatgcaaggcgcccagctacgtcatcagcaacccgctcccggccgcaagccggtgccgcgcggtgccagccggatggtggccaaggagccgatgtcggcgcgcctgccgaaagccaactttggcgtgctgaaaagcctgatgtggccggtgctgctggtcgcgctgggcttcggcacttacgagggcgcgcagcgcctgttgccctatgccgaccggccgatcaccaaggtcgcggtgcagggcgacctgagttacatcagccagcaggcggtgcagcagcggatcgcgccctacgtcgcggcgagcttcttcaccatcgacctggcgagcatgcgtaccgagctggaacagatgccatggatcgctcatgccgaggtacggcgtgtgtggccggaccaggtagtgattcgcctggaagagcagttgccggtggcccgttggggcgacgaggcgctgttgaacaaccagggccaggccttcaccccgcgtgaactggcgaactacgagcacttgccacagttgttcggcccgcagcgggcccagcagcaggtgatgcagcagtaccaggtgctgagccagatgctgcgcccgatgggtttctccattgcccgtctggagttgcgcgagcgcggcagctggttcctgaccacgggggccggcagcgctggccctggtatcgagttgttgctcggacgcgatcacctggtggagaagatgcgccgcttcattgccatttatgaaaaaacgctgaaagaacagattacgaacatcgcgcgcatcgatctgcgttatgccaacggcctggccgtcggctggcgggaacctgtagcgcccacgacggcccaacccgccgtcgcgaagaattaagaagaggcaggaccatggcaaacgtgcaaagcggcaaaatgatcgtcggtctggatatcggcacctccaaggtggtggcgctggtaggcgaggtcgcggccgatggcacgctggaaatcgtcggtatcggcacccatccatcgcgcggcctgaagaagggcgtggtggtgaatatcgagtccaccgttcaatcgatccagcgcgcggtagaagaagcgcaactgatggccggttgccgtatccactcggcattcgtcggcgtggcgggcaatcacattcgcagcctgaactcccacggcatcgtggcgattcgtgatcgcgaagtgagctcggcggatctggagcgggtactcgacgcggcgcaggccgtggcgattccggccgaccagcgggtgctgcacaccctgccgcaggattacgtgatcgataaccaggaaggcgtgcgcgagcccctgggcatgtccggcgtacgcctggaagccaaggtgcacgtggtgacctgcgcggtgaatgccgcccagaacatcgaaaagtgcgtgcgtcgctgcggcctggaaatcgacgacatcattctcgaacagctggcctcggcgtattcggtgctgaccgacgacgagaaagagctgggcgtgtgtctggtggatatcggtggcggtaccaccgacatcgcgatcttcaccgaaggcgcgatccgccataccgcggtgatcccgattgccggcgaccaggtgaccaacgacatcgccatggcgctgcgtacgccgacccagtacgccgaagaaatcaagattcgttatgcctgcgccctggccaagctggccggtgccggcgaaaccatcaaggtgccaagcgtcggcgaccgtccgccgcgcgagctgtctcgccaggccctggccgaagtggtcgagccgcgttacgacgaactgttcaccctgatccaggccgaactgcgtcgcagcggctacgaagacctgatcccggccggcatcgtgctgaccggcggtacttcgaaaatggaaggcgcggtcgaactggccgaagagattttccacatgccggtccgcctgggcgtgccgcacaccgtcaaaggcctgtccgacgtggtgcgcaacccgatctactccaccggcgtgggcttgctgttgtacgggctgcagaagcagtccgacggtatctcgttctccggcatcggtagccgggacagctacagcagcgacgaacccaaggccgccttgctcgatcgcattaagagctgggtgcagggcaacttctgaagatttaccgcaacaccgttgtaagcagtaggcgaaaaaactagagaaatgaaaggagagggaaaatgttcgaactcgtagacaatgtccccgcaagtccggtaatcaaggttatcggtgtcggcggtggcggcggcaacgccgtcaatcacatggtcaagagcaacatcgaaggcgtcgaattcatctgcgccaacactgatgctcaagcgctgaaaaacatcggcgcgcggaccatcctgcaactgggtaccggcgtgaccaagggcctgggtgctggtgccaatcctgaagtcggccgtcaagccgccctggaagaccgcgagcgtatcgctgaagtgctggcgggcaccaacatggtgttcatcacgaccggcatgggcggtggtaccggtaccggtgctgcgccgatcatcgccgaagtggccaaggaaatgggcatcctcaccgttgcggtggtgacccgtccgttcccgttcgaaggccgcaagcgcatgcagatcgccgatgaaggcatccgcgcgctgagcgaaagcgtcgattcgttgatcaccattcccaacgaaaaactgctgaccatcctcggcaaagacgccagcctgctgtcggctttcgccaaggccgacgacgtcctggccggtgccgtgcgcggtatctccgacatcatcaagcgtccgggcatgatcaacgtcgacttcgccgacgtacgcaccgtgatgagcgaaatgggcatggcaatgatgggcactggctgcgccagcggtcctaaccgtgcacgtgaagcgaccgaagcggcgatccgcaacccgctgctggaagacgtgaacctgcaaggcgcgcgcggcatcctggtgaatatcaccgccggtcccgacctgtccctgggcgagtactccgacgtgggtagcatcatcgaagccttcgcttccgagcacgcgatggtcaaggtcggtaccgttatcgatccggacatgcgcgacgagctgcacgtgaccgtggttgccacgggtctgggcgcgaaaatcgagaagcctgtgaaggtcatcgacaataccgtgcaaacctccatggccgctgcacaggcgccagcacctgcgcgtcaggaactgccgtcggtcaactaccgtgatctggaccgtccgaccgtcatgcgcaaccaggcccaggccagtgctgcgactgcggcgaagctgaatccgcaagatgatctggactatctggacatcccggctttcctgcgtcgccaggccgattgatggaatgtatcaggggtattagggtgattggtgttcagcaaaggtctggtctgctattatcgccagcctttgttgataccagttcgcaatttgcgctgaagcggcctaagccatgattaaacaacgcaccctgaagaatattatccgtgccacaggtgtaggcctgcactccggggagaaggtttacctgaccctcaagcctgcgcctgtcgacaccggcattgtgttttgtcgtgccgacctggaccctgtggtgcagattcctgctcgcgcggaaaacgttggtgaaaccactatgtcgaccaccctggtcaacggtgacaccaaagtggacacggtggagcacttgctctcggccatggctggcctgggcatcgataacgcctacgtcgagctctccgcgtccgaagtcccgatcatggatggcagcgctggacccttcgtattcctgattcaatctgccggcctggaagaacaggacgcagccaagaagttcatccgcatccttcgcgaggtgacagtggaagacggcgacaagcgcgccactttcgtgcctttcgacggttttaaagtgagctttgagatcgattttgatcacccggttttccgtgaccgcacccagagtgcaagcgtggacttttccagcacttcgttcgtaaaagaagtcagccgcgcccgtacctttggtttcatgagtgatatcgagtacctgcgcaagcacaatctcgcactcggcggcagcgtggaaaacgctatcgtggtcgacgcggatggtgtactgaacgaggacggccttcgctacgaagacgaattcgtgaagcacaagatcctcgacgcaattggtgacctctacctgctgggcaacagcctgataggtgagttcaaaggcttcaagtcgggccatgcactgaacaaccagcttctgcgcaagctcattgagcagaaagacgcttgggaagtcgtgaccttcgaagatgccagcactgcaccgatctcttacatgcgtccggttgcggccgtgtaagtaacactctctttcctttagtttttaaaggctgccctcgggtggcctttttttatgtccgcagattcctgcgcggctgatgaggttatcgcgggcagcacgggagcaatagaagcgaggcttggccacgatgggctcagcccgccaccacccggtttcgcccttcggccttggcctggtacagcgccttgtcggccatcgagcacaacgcttccaggctggacttcggcgtgcccgcccaggtgctgaggccgatgctgatggtgattggcgaggcgccatcccggatcggcggcaggcgctcgatcgccaggcggatatgctcggcgatacgccgggcgccttcgttatcggtctccggcaggaccacggcgaactcttcgccgccgtagcgtgcggccaggtcgccggggcgacggatattgtcactgatcacccgggccacgatgcgcagggcttcatcgccgagcgggtggccgtggcggtcgttgaaggccttgaagtgatccacgtccaacatcagcagcgacagggcgctgtgggagcgttgcgcgcgtccccattcgcgggccagggtctggtccaggctgcggcggttgtccaggccggtgagcgcgtcagtggcggccagttgcgcgagttcctgctcggcgctctggcggcggcgcaattcccggcaaagcagccaggtcagccacagcaggcccaggcacagcgcaccggtggcgccgccgaccaccagcgcggtgcgctgccaggaggcgaagacttcattgctggagagcgccacgatcacgatcagcggcaggtctccgacctgggagaaggtatacaggcgcggctgctgggtgctggacatgcctttgaagctgccgttcccctcgcgcaggatgcggatgaaattgggccgttggctgaagtcctgaccgatcaggttgtccgctcgcggtggttcctgggccagcaggataccgtcgctactgatcaggttgaccgagctgtcgcggccgacattcaggcttttgaacaattggctgaagtagtccaggcgcatggccgcttcggccacgccgaggaactccccgtgctcgccggacacgcgccggctgaaactgatgcgccaatccagctcgggcgggcgggcgcggaacggtcggctgatcagcatgcccggatctgggttgttcacatggggctggaaatactcccggtcggcaaagttgccctggcgcggttcgaccgaggcggagtcggcgagcacgtcgccgcgcgagtcgagcagcaggatgttgcccttgtagggggctgcggtagcccggtcgaacagcgccatatggcgaatggtcggcgatacctgcttcaggtcgtcgcgttgcgaggcgctgatcaggccacgcagggatacgtcgtacagctcgacgttgcgcagcacgtcggcgtcgatcaattgcacgatgttggaagccgcgcgggtggcggccatttcggcgctgccgcgttcgcgaatcagcaagaaggtcacgatgctcaggatggagatgaccatcagtgagcttccaagaatcagcatcctttccgaccgggtcaaagtggtcgtgttgcggggtgtcgcactactcacactcatggttctgacttctgcggtgtgtacgtttcaggggtgtttccggatgaagcaagcagagttgcagagaccgatcgcgcctgcgggcgcatgtataaatcgcagacaaaaaaaaggccagcaaaatgatgctggccttttgcttattcgagcttagaacacattgaatgggtaatcgacgatcacccggtattcgtcggtgtcattgtccagcgcgccataaccgttgccgccacggttggtggcccactgcaggcggaccgccagatccttggcctggccaccctgcaccacgtacttgaggtcaaggtcgcgttcccagtgcttggcgtgctcgccgccggtgctgtaccagttggcgtagccacggctgtgcgggtcgaccttggtcaggtccagctcgccgcgcgagtaggagagcgccgaagtcaggcccggcaggccgaggccggcgaagtcgtaggcgtacttgagtttccacgaacgctcgttggggccgttgaagtccgaatactgctgggaattgtccaggtagatgctgtcgccctggttgatgtagtcgaacggggtgttgccgttcacccgctgataggcggcggtgaggctgtgatggccgacgcccagggtgaaatgcaggctgtaggtgttgttgtcgatgtcgcccagcagcgcgtcgccggtgtcctgggtgtgatagaagtgcaagcccgggttcagggtcaccagctcgttcagcgcatagctgtagtcgaggtcgtagtagtactggttccagatgttcttgagttcggcggcgtacaggctgctggtcagcccgggcacgccgctccaggccacgccggcccagttcaggtggcggctttcgtcgccattcgccagtttgccgtaggccgtgtcgatacgtcggcggccgctctggttatagggcttggtgaagctggcctggccgccttcgagcagccagccgtcgaagctgtggttggccaggctgaccccgcggaaggtctgcggcagcatgcggctctggccgccggcgatcaccgggttgttgagaaacaggtcgccggccttgagctcggtgtcgaaggcgcggattttcagggtggcgccagccgtggaaaacgacgtcggcgctttgccgctgccatcgctgaccggcaggatgctcgagttgtcggtgccgccaccgccatcgagtttcaagccgagcatggcgttggcatcgaggccgaaaccgaccgtgccctgggtataacccgactcgaaaatccccaggaaaccctggccccactcgatgttgtcatcgttctgctggtggcggttgcgattcatgtagtagttgcgggcgttgagcttgaggcttgcgcctgcgacgaagccctcggggctggcctcgtcggcggcctggacacagggggcgatagttgcagccattgcaatgaacaacgggctgagagtggaagtgaccttcaccggtaaaaagctccttggatgaatgatgagagttgttattgtcgattcgggtgtttcttgttctgggtgaaacgaatgaaacagtcagttctacatggcaaaaaaaagccgctgttatcagcggctttaagacaacttactccggggggtagagcagagaagttgtcgagggaaacgagtcggtagcaggtgtcagctgtccttctgaacgtccggctggcgttgttccgccgtgatgttctgcggctgctcgccgttctgttgcttggtagccagcgcttcctgggcgtcctggaaggcagcggcgcgcgcggcgttatgcgcggcgaaagtctgcgattcttcggccatggccataggggccaagaacagggaggacaaaacaaacgcgctggcaatacccatactgttggacatttctgaagaccttcttgcagagcaagttcaaattaggtgcgacaaaaatataacttcaaggcggctggaaaaagcgccgaacaggataagcactgttacgccaaaagcaatagttgacaccgcttctgtaggcgccaggctggccggcgatgcaggcaatgcgctgtgtctgatgcaccgccatcgcgagcaatcgagcgtcgaccggctgctcctagagaggagagggagagctcagatcggcaggtagaggccgaaggtgttcatgccgtcatcgctgcgcacgaacacgtcgccaccgtgcatcagggcgatggccttgacgatcgccagccccaggccgtggttggcgccgctgttgctgcgggaggcatcgacccggtagaagcgctcgaacagccggggcaggtgctcgctggcgatggcctggccgggattgctcacggcgatggtcacctgatgttcctgcacatcgatctgcacccggatcacctgcccgggctcggtgtgttgcacggcattgctcagcaggttgatcagcgcccggcgcaggtgggcgatctcgatctgcacctgggcatcgccgcggacctcgaccttgacctgggcgtcctcgaggatgaaatccaggtagtccagggtggtggccacttcactggccagggaggtgctggtgagcttggtggccttgctgccctggtcggcgctggccaggaacagcatgtcgttgatgatcgagcgcagccgttccaactcttcgagattggattgcagcacctcgaaataatgctcggcggagcgcccgcgagtcagcgccacctgggtctggccgatcaggttggtcaggggcgagcgcagttcgtgggcgacgtcggcattgaaggattccaggcgcgaataggcttgttccacccgctccagggtcgagttgaacgagttggcgaactgcgtcaactccggcggcagcgatgacagctgcaagcgtccggaaagcctcggtggggccaggcgctgggcctcttcggacagcccgatcaagggtttcaggccaatgcgcgccacccagtaacccagcgccgaggccagcagcacgccgacgatggccaggctgatcaaggcaatcagcagctggtgctgggtctcgtagaaggtctcggtgtcgatggcgatcagaaagcgcagcggcgggcgcagctccttggccggcagttggctgaccagtactttcagcggatagggatgcccgggcagggtcaggtcgcgcatgcccagcgggccctgggcgaagcggcggatctgcgggtcagggttgccgtattcgtaggcgggatcgccgctgaccacccagaaacggatgcgcttgtcttcttcgctgagcagcttgagcttgttgttgatcttggcccagtgctccgggttgccgaagcgcgtcagggccgactccagcacgctgtagcgcgcatccagctcggcctcgggcagcaggcccaggcccttgtccacctgttgatagagcgcgccgccgatcagcaggaagatcagcagggccaccagggtgaacagcccactcaggcgcagggcaatcgaattacgaggcaccgcggttctccagcacgtaacccatgccgcggatggtgtgcagcagtttctgttcgaacggcccgtcgagcttggcccgcaagcgcttgatcgccacttcgacgacgttggcgtcgctatcgaagttgatgtcccagaccatctcggcgatcgcggttttcgacaggatctcgccctggcgtcgggcgagcacgctgagcagcgagaactccttggcggtcaggtccaggcgcgtgccggcgcgactggccttgcggctgatcaggtcgatccacaggtcggcgatgctgatctgcaccggttcgtggccgccgctgcggcgggtcagggcctgcaggcgcgccaccagttcgaggaaggaaaagggcttgcccaggtaatcgtcggcgccgtcgcgcaggcccttgatgcggtcttcgacgcgctcgcgggcggtgagcatgatcaccggcgtctgcttgcgcgcgcgcagcgcccgcagcacgccgaagccgtcgaggccgggcagcatcacgtcgagcacgatcaccgcgtagtcgctttccagcgccaggtgcaggccctcgacgccgtcgcgcgcgaggtccacggtgtagccttgttcggtcaggccgcggtgcagatagtccgcggttttctcttcgtcttcgataatcagaacgcgcatgaccccgcctcaggatgtgcttgccagcgctggcgctggtgtgggccgatggaatagccgctcgagccacaagtatatgaccggagtggtgaacagcgtcagcgcctggctcaccagcaggccaccgaccacggcgatccccagcggctggcgcagctcggcgccggcgccatagccgagcatcagcggcaaggcgccgagcaaagcggcgagggtggtcatgatgatcggccggaagcgggtgatacaggcctggtagatcgcctcctgcggcgacagcccgcccttgcgctgggcttcgagggcgaagtcgatcatcaagatgccgtttttcttgacgatgccgatcagcagcaccaggccgatcaaggccatgatcgagaagtcctggcccagcagccagagcatgatcagcgcgccgaggccggccgagggcagggtggagatgatcgtcagcgggtggacgaagctctcgtagagcacgccgaggatgatgtacaccgccaccagcgccgcgaggatcagccacggctggctggccagggagctctggaaggcctgggccgcgccctggaaattgccggcgatggaggcgggcatgccgatctggttttttgcctgctcaagcatgatcaccgcgtcgcccagggccacgcccggcgccaggttgaacgacaggttggcggccgggaacatgccgtcgtgggcgatggacaacgggccgacggtgggcgggtcgaccttggccagcgccgacagcggcaccatctcgccgctcaggggcgagcgcaggtagaagtaattcaggctctcggccttgccgcgctgctgtgcgtccagttcgaggatcacgttgtactggttggtctcggtctggaactcgttgacctggcgctggccgaaggcgtcgtagagcgcttcgtcgacatcggtggcggtcaggccgaaacgcgccgcggcgctgcggtcgatgctgatatgggtgatgctgccgcccagttgcaggtcgttggacaggtcgcgaaaggccgggttggcccgcagtttttccgtcaggcgctgggtccaggtattcagcgtcggcccgtcgttgctcttgagcacgtactggtactggctgcggctcggtccggagctgaggttgatgtcctggccggcccgcaggtacaggacgatgcccgggaccttggccagctgcgggcgaatgcggtcgatgaactggctggcggagacgtcccgctggccgcggtccttgagggcgatccagaagcggccgttggcgatggtctggttgttgccggtgacgcccactgagtgggagaaggtttccaccgccgggtcggcgccgaggatcttcgccagggctaggtgttttgccaccatgtccgggtaggagatgtcggctgccgcttcgctggtgccgagcacgaagccggtgtcctggaccgggaagaaacccttgggaatgaatacatagccggcgatggccaggcccagggtcaggccgaacaggccgagcatcagccgctgatgggccagggcccgacgcagcccgcgttcgtagagcgccagcaggcgttcgctgaagcccgggcgatcgtggggatgatcagtcagcgcgcgcatgaacagcgccgccagggtcggcgccagagtcagcgacaccaccaccgaaatcaggatggtcgaggtggcggtcagggcgaactccttgaacagtcgcccgaccacgccgcccatgaacagcaggggaatgaacgcggcgatcagcgagaaactgatggacaccacggtgaagccgatttcgccggcgcccttgatcgccgcctcgcgcatgccgtcgccggcctccagatggcgatggatgttctccaccacgacaatcgcgtcgtcgaccacgaagcccaccgagatcacgatggccaccagggtcaggttgttcaggctgaagcccatcacatacatcagcgcgaagctggccaccagcgacaccccgagcacgctggagacgatcagcgtcgccgacagctggcgcaggaacagcgccatcaccgccaccaccagcagcaccgcgatcagcagggtgatttccacctcatgcaaggacgcgcggatggtcttggtgcggtccgagagtacggtcacgtccaccgaggccggcagcatggcctccaggcgcggcaactcgccctggatgcggtccacggtgtcgacgatgttggcccccggctggcggaagatcactaggttgagccccggctggtcgttggaccaggcctgcacgtaggcgttttccgggccgctgatgacccgggcgacatccttgagctgcaccggcgcgccgttcttgtaggagacgatcaactggccatagtcatcgggatggaacagttggtcgttggtcgacagggtcgagatgctggactcgccatacagcgcgcccttggccaggttgaggctggcctgctgcagggcgacgcggatatcggccagggtcaggccgatggccgccagccggtcgggcgaggcctggacgcggatcgccgggcgttgctggccggtgatgttgatcaggccgacgccgtcgatctggctgatctgccgggccagcagggtttccacgtagtcgctcagttcagtgccgggcatttgcgtggagctgatgctgaggatcagcaccgggctgtccgccgggttgaccttgcgccaggtgggcaggctcggcatgtcattgggcagcttgcccgaggcggtgttgatcgccgcctgcacttcctgggcggcggtgtcgatgctcttgtcgagggtgaattgcagggtcaggttggtcgagcccagggcgctgctggaggtcatctgggtcatgccggggatggcgctgaactgcacctccagcggcgtggccaccgaagaggccatggtttccgggctggcgccgggcagttgcgcggtgacctggatggtcggaaattcggcctccggcagcggcgctatgggcagccggggaaaggcgatggcgcccagcagcaccagggcgaaggtcagcagcagggtggcgaccggatggtcgacgcaccaggcggagatcgagccgtggcccttcatggctgtggctccatgttcgccgcctggatctgttgcggcggttcgctgagcacttcgatgcgcgaaccggccttgagccgcgactggccgtcactgaccagcaggtcgccggcttgcacgcccttgatgatgttctggccgctgtcctgatagaccatctgcaccgggacgatttccactttgtcgtccttgacccgatacacgaagtgtttgtccaggccgcgctgcaccacgccgggcggcaccaccagggcggctttttccacggcggtctggatcttgatggtcaccagttggccgggccagagcttttgcccggggttgctgaattcggccttggcgcggatggtcccggtgttggtgtcgatctggttgtcgatcaggctcaggtggccttcgcccaggcggtcgcccgtgtcggagtcggtatcggcgcccaggtaggcgtccaccgaggccgggtgctcggcggccagcaggccctgcaaggtcggcagcatctgttgcggcaaggaaaactcgaccgcgatcgggtcgatctgggtcaccgagaacaggccctgggtatcgctggtgcgcaggaaattgccttcgtcgacggtgcggatgccgacgcggccggacaccggcgagcggatctgggtataggacagctgcacctgcgccgcatcgatggcggcctggttgccctgggcgctggccttgagctggttgaccagcgcttgctgctggtcgtaggtctgcctggacacgccgtcatccaccgacagcagcttgtagcgcttgaggttgacctgggccacttgcagttgcgcctggttttccgccagttgcgcccgggcctggtcgaggctggcgcggatcgagcggtcgtcgatggtcgccagcaggtcgccggccttgaccaactggccttccttgaccagcagccgggtgaggatgccgtccacctgggggcgaatcaccacgctgtgcagcgacagcaccgagccgatgccactgacatgccgcggcacatcctgttgggcgacgctgatcactcgcaccggcacgacggtcggcgcggccagtctggcgctgggcggcttgagcaggtaccacaggccagcggtggcgagaacggcgagcacgcctgcgagcacaagggttgtttttcgattacgcatggacgccagcgccggggggcaagggagacgggaagatggccagaatcgatggtccctttatagccggccgacccggtcagcaacgtgacgcctgcctgacagcgctgtcagcaaaggccgaccgatgacctttggccgatgacggtcgcggccgctcaacgatccgcaacgcgggtatactgccggccttcgcggcccgcttccccgggcccggcctttgctttttacccggagcttccatgactaccccagcacaaccgcctgtgtccgacgcgcccagcgccgaccaggtcgacgacgccagcgcgcctggcgaaggcaagccggcgatcgcgccgttcaagtttccgttcaagccgtccgagttcgcccaggccaggaatgcccagcaaccctggtacaagaacggcgccaccaacggccacaccaagaccccaggcgcggcgccacccggcacccgtcgctcgatgggcaagcgctgagtccaagcttctgtagccgctgtcgaaggctcgggccgcgttcggacgatcgaccgccaagcgggcgcacgaccttaagatcgccgaaggccttcggccttatcgcagcctgcggcagcggctacaagttccgcgaatgccgcgatatcccaatccgtgtagccgctgccgcaggctgcgtacgagcggcacgctcgcaacgatttgacggacaccggagactctgcgggtcagcggcagggcttcatgctgcccgcagggaaatgaaggcgtaggtgagcggcgcctcggtcaccacctgggcgccggcgtcctgcacttgcccggcaatgtcttcaccggatacatggaacagccactcgccggccggcgtcagcggttgcgcctggactcgctcgatggcttcggccagggcggccatgtccggcaggtaggcggtaaagccgtcgcccttgagggcggtggtgtgaatgcccagcagttggcagatggcttgtttgctgtggatatcgtcgcggtcggcctggcgcgagcgctggatcagttcggccagctcccggtccaccagctcactgccgacgatcagctgcgggcctttttcccaggattcgggcgggcaatccttgaccgccgggttgagcgggatgtgcggattgatttccatcgggtagatgcggcacaccagcggccggcgttcatagatccggcacagctggtcttcgtcaagattccggcaggggccgacgttgtaggcggcgaaggtgatcgccacgtgggcctgggtattgccgctgggcaccacgcaggaacgccgctcggcgtgctcacgctgctgggccggcagccccaggccattgctcaggaagccttccaccagcacgatcacctggccgccatccagcgcccactggcgggcttcgccgagggtcaggggaacgtgatgatcgttgcagcacttgccgcagcctacgcaggaaaaacgagtattcattgagccggtagccatagtcgaaaggcggaagcggcgacggaatgactcacatcgccctctaaatagcgctctcgaagcaagttatgcgccagtcaccggcccttggcctcgagggcggggcggatcgaatcccattcggtgacatgggcgctcttgcgctgcttgtcgtacaggcacagttccacgccggtctggcccttcatgtgtttttgcgggtactggccctggagcagcaacgcgctgtagccgacccggtcgtcgaactgcgcggcgttgcccagcactttgacattcttcaactggctggccttggtgcagctggcccgcacctgcttgtcgaaggtcgcccaggcatccgggctggaggcctgggcctggctggcgaggagggcggtgaggcaggcgaggcaggcgaggctcagaggcagggctttcatggcggggcgctccttcgttcacgggtatgcgcagggagtatgcctgaggcgcgagtgatgaaagatctgtagccgctgccgcaggctcgggccgcgttcggacgatcggccggaacggccgcggcgatcttgaagtcgctgaaggtcctgcggaccttatcgcagcctgcggcagcggctacagggattgcagcaggtgctgcggcagcggctaccggttacagcggcgtgtggggaacctgctcgcggcggatcacccgcatgccgacgcttgcgtagagctcgcgagcgcgctggttgtcttccagcactcgcaggtcgacaaaggcttcgcggcgctggcggaagacctcgaaggcctgcagcagcaaggcccgtcccagaccctggccgcggacccgcggatgcaccaccagatccttgatataggcgctggtccagcactggatcaccccgacgatgccctcggcatcctgggccaccaggcacagttgcgggtcgtattcggcgtcgctttcgaaacgctggcgccagctgtccagctccggcacgctcccgccgccgtcttggtagccaaggtgcatcaggccatgcaccgctgcggccaattccggccgatagctgtcgaggctgaaggcggctggccaactggcgggctccagttgcccggtcaggtcgcggcgcatcagcaggcaatagtcgtcggccatggctcaggcgctctgggcggcgacgtgacgggccgcttcgatcaggcagcgggtcaggtccggcgaggaaaacttggtcagcaccgcgttggcgccggccaggcgggccttttccgcgttcatggcactgtccagggaggtatgcagcaggacgtagaggtgggcgaagtccggggtctcgcgcagggtgcgggtcagggcgtaaccgtccatctccgacatctcgatgtccgagacgatcaggttgatctcctgggcggtgccttgcaggtccagcaggcagtcgatggcctccttggcgctgcgcgcggtgtggcattgcaggccgaggttacgcagggtatgcaccgactgctgcagggccacctggctgtcgtcgaccaccaggatccgcgcgttacccagcagttcggcgtcttgcatgctcagctcggtcggcgcggtttcgatctgcgccggggcgatgccatggatgactttctcgatgtccagtacctgcaccagggtgccgtcgacctgggtgaccccagtgatgtaggacttgaccccaccggagccatagggcggcggacggatatcggtggtcaggcaatgcacgatcttgctcaccgcctgcacatgcaggccctgcttggagcggctgacgtcggtgacgatcaggcagccaccctccgggtcttccagcggccgttcgccgatggcccggctcaggtcgatgaccgacagcgaattgccgcgcagggtagcgatgcctttcacgtgcgggtgcgattccggcagtttggtcagcggtgggcagggaatgatttcactgactttgagcaggttgatcgccatcagcttgccgctgcgcaaggtgaacagcagaagcgaaagagagtctgcgcgggctttgttggaagacataaaaaccttctgtggaaaaaaggtggttcgcgccatgggccgcgaacagctagcgataacgggttatcgacgcgcaaagggctggctttaggcttaatcccaatatccgcgacccgcgcaatctgtagccgctgccgaaggctgcgatcgaggacgccgtcctcgcaagatcagccattgcgtcgtttcggtcacccctcatgtagcgggtccacggccgtttcgtcgcaatgccgcccaggctaatcgcagacttcggctacaggtgagtcacttcaagcctagcctcttggccatgcgccccaggttggcacggtccaggcccagctcgcgggcggcgctggcccagttgtgctggtggcgttcaaggcaggcactgatcagctggcgctggtagttttcggtggcctggcgcagatcaccgctgccgggagtctcggccatggctgccggggcgggctggggcgctaccggcgccgaggcgtccggcaagtccaggtcggcggcgctcaggctgaggatcttcggtcgttcgcggcagttgcccagggccttgagggcgctgcggccgatcaggtgttccagctcacgcacgttgcccggccaggcgtaggccagcagcgccgcctgggcatcgctggtcaggcgcaggctgcccaggcccatgcgcgagcgattctgttcgaggaagtagccgctgagcagcagcacatcgcggccgcggtcgcgcagggccggcaccagcagcgggtagacgctgaggcggtgatagaagtccgcgcgatagcggccgctgcgcacttcttcggccaggtcgcggttggtggcggcgatcagccgcacgtcgacctgatgttcctggtccgaacccaggcgttgcagctggccgctttgcagcacgcgcagcagcttggcctgcacggtcagcgacaactcgcccacctcatcgagaaacagcgtgccgccattggccagctcgaatttgccgcggcggtcgttggtggcgccggtaaaggcgccccgcacatggccgaacagttcgctttccaccagggtctcgggcagggcggcgcagttgaggctgatgatcggtttgtcggcccggggcgaggcggcgtggatggcctgggccaccagttccttgccgaccccggtttcgccggtgatcaacaccgtcaggtcgctgccgccgaccaggccgatttcctccagcaggcgtttgtgggctttgctctggccgatcatctcgcggttctggccgctggcctggcgatagacctcggcgcgctggtgttcgtcttcggcgcgcagggccaggcgctcgatgcgctcggcggcgttgacggtagccgccgcgaggctggcgaacgcctgcagggcatccagttcgatcggctcgaagctctgcgggtcgagggcatccagggtcagcaggccccaggggcgctcgtcgataaacagcgggcagcccatgcagtcatggacttccaggtgttcgtgcaggccatccaccaggccgtcgtaagggtccggcaagtcgctgtcgctggcgaagcgagtgggtccggggtggctgagcagggcggcgaaacgcgggtgttcgctgaccttgaagcgccggcccagggtgtcggtgctcaagccgtccaccgccagtggcaccagccattcgccatccaggcgcagcagcgcggcggcgtcgcagggcagcagggcgcgcatggcttccagcaggcggcggtagcgctcgccttcgggcagttcgtgggacaggtcggagaccaggggcaacaaggcggtgagcagggattttgcggtcataatgactccgtatggtcttaatgactataaatgcggctttgtcgatatgactacatgtattttaagtagttgatttatatgaattttatttttggcacgaaaactgattggtaaagggcaacctgcaagtagtcagaaagctcaggagttgtacttatgcttagcgtcgaagatcgtgccatcatcaaatccaccgttccgttgctggaaagcggtggcgaagccctgatcacccacttctaccggatgatgctctccgagtatccgcaagtgcgcccactgttcaaccaggcgcaccaggccagcggcgaccagccacgggccctggccaatggcgtattgatgtacgcccggcacatcgaccagctcgaccagttgggcgatctggtggccaagatcatcaacaagcatgtggccctgcagatcctgccggagcattacccgatcgtcggcagctgcctgctgcgcgccatctccgaagtgctgggcgaagagatcgccacgccggcggtgatgagcgcctggggcgcggcctataaccagctggcggacatcctgatcggcgctgaaggcgcgatctacgaccagaaggcccaggccccgggcggctggcgtggtgcgcgggagttcaagctggtccgccgcgagcaggagagcgcggaaatcacctcgttctatttcgagcctgtggataatggcccgattctcgccgccgagccgggtcagtacatcggcatgcaactgttcctcgagggtgaggaaatccgccgcaactactcgctgtcggccctgtccgacgccggccagtatcgcatcagcgtcaagcgcgaggccggtggccgcgcttccaactacctgcacgaccagttgcagatcggcgccagcatccagctgttcccgccagcgggcgaattcaccctggcggacagtgacaagccgctggtgctgatcagtggtggcgtcggcatcacaccgaccctgccgatgctcgaagccgcgctggccaccgagcgtccggtgcactttatccactgcgcgcgcaacggtggggtgcatgcgttccgcgattgggtcgacggcctggccgcgcgtcatccgcaactcaagcgcttctactgctacgccgaagacgacggcgtcagcccggcggcggacaaggtcggcctgctgagccaggaacaactggccgaatggttgccgcaggagcgtgacctggacgcctacttcctcggcccgaaagccttcatggcggcgatcaagcgtcacctcaaggccctgggcgtaccggaaaaacaaagccgttacgagttcttcggtccggccgcggcgctggagtaaaaagctgcgccagcctccacccggaggctggccgcctgtagccgctggcgcagcctagcgatcggggcacggccccgtaaacctggcgacgcggtatgccggagctccggtgtcgcctggtcttgcggtcgctgcgcaaccgatcgcaggctgcgccagcggctacagggcgcactcgtaaaaatcctttaaaggttaatccgttcttaacctgtttatcgttaattccccgatgctgatgataggcgctcgttcgcactgatcaggatcatcccatgcaactcccagccatttcccgcatcaccctggccgcaaccctgctcgccagtcccttggttttcgccgagccggccttgctccaaccgcagaccctgatcgtcgatcagagcctgcccaaggcccagcgtgaagccatggagctggccgcgcggcgctacggcagtttctggaacagcggcgatgaaagcctggccagggccgcgctggcggagaacttcgtcgatatgacgccgccggaagggcgggtccaggggccgacggggccgctactggcgtcgcggttctttcgcacggcggtgccggacttgagcgcagacatcgagcagatgatcgtggccggggatcgggtggtgctgcacctgcattttcgcgggcacttcagcgggaccttcaatgcactcaaaggtcatggtcagcgtgtagacttccgggcaaccgacatctatcagatcgccgatggccggatcaccgccaattggcatatcgaagacaacctcagcctgatgcagcagttgcaaacgctcccatcgggttgagccacagacagaaaggaattgaggatgactgacgacacactgcgtttggggcgcgagcgacgttttctggtgttgctggggctgatctgcctggcgctgatcggcggcgcgctgtacatgcaggtggtgctgggcgaggcgccttgcccgctgtgcatcctgcagcgctacgcgtttctgctgatcgcgattttcgccttcatcggcgcggccatgcgcagccgtcgcagcctcaccgtgctggaagtgctggtgatgctcagcgcgctgttcggggcggcggtggcggggcatcacgtttacacccaggcccatcccgcagtcagctgcggcatcgatgtgttgcagccgatcgtcgacagcctgccgctggcgactgtcttcccgctggggttccaggtcgatggcttctgctccacgccgtacccgccggtgctgggcctgtccctggcgcagtgggcgctggtggcctttgtgctgaccctggtgctggtgccgctgggcatcattcgtaaccgtcgccacagcgcctgacccggcataaaagccccggtcccgatgttcggggctggggcttttttgcgtgtaggacaatgtgtgaagggcgcgtgatatggggcaatcggatgcgcgataaaagtgcgacatgttgtcacatggtggtgtcgcagctgtgtttcagcggatgacgtcgagacgatttttcttgcgccaggagcgaaaaaagtctgtcagttcgtgtcggcgcggtgaacggccaggcaagcatagcctgctatctaaataaatcgattcagccctcgttttacaaggggtagcgcgatgccatcggtggattttgcaggggtgaaagacgcctttttcgacctggctggaaggcgtttttggggctttttattgcgaatgaatctcgatatgatcgcgacccgttgcaataatcgccacgcattgttgcgcgagtcgataaaaattatttcgggataagacatggtttataaaacgctacatatctacaatcgcccgcactgaatttccggcgctgctcacccctgagcatacggcggcggtcgaggggcgttggacgctccatgcgaccccaggtgtcggcaccttccaaatatccgcaccaaatggaattggtctgtaaaaggcctttgaccacgaattcgaataagaactcactgctggcccaggatttgtcaaacaacgcgtaacgcgtcgggcaggcccttattcaatcgaagaaaaaatgccaacccttggcacggtgaagtgttggcgatcaaaacccaactgcatggcgcaagctgctttagaggtcgtgagatgagtaaaaacaggtacccccgattactaggctttttgccgctgcttggcatgatgttaatgctgggaggctgcaagtggaccttgctcgacccaaaaggacaggtcggtctggatgagcgaaacctgatcatcaccgctaccctgctgatgctgctggtcgtgattccggtgatcgtgatgaccttcgcgttcgcctggaaataccgcgcgtccaacaccaacgcgacctacgcgcccaagtggtcgcactccaccaagatcgaaatcgcggtgtggctggtcccgatcctcatcatcattgccctgggttatgtgacctacaagtccacccacgcgctggacccgtatcgtccgctggaatccgacgtcaagccgatcaacatcgaagtggtcgcgctggactggaagtggctgttcatctacccggaccagggtatcgcaactgttaaccaaatccggttcccggagcacactccgctgaacttcaagatcacctccgacgccgtgatgaactcgttcttcatccctgcgctgggcggccagatctacgcgatggcaggcatgcagaccaagctgcacctgatcgccaaccagaaagctgaaatggaaggcatctccgctaactacagtggcgctggcttcaccggcatgaaattcaaagcgatctcgacgagccaggaagatttcgacgcctgggtagccgaagtcaaggccgcacctaaacagcttgatcaagctgaatacgaagcccttgccaagccaagccagaacaaccctgtcgcgctgtactcctcgtacacgccggacctgtttcagaaaatcgtcgacaagtatgaaggcatgaaaccaggcaagccggtcaagcacgagaagaaagaagtggccgctgtggaagggactgacatgagctcgcattcagctgctggggcagaggagtaaacgatgtttggtaaattaagtctggacgcgataccgttccacgagccgattgtcatggtgaccgttgccatgatcatcctcggtggtctggcgcttgtcgcgggtatcacgtacttcaagaagtggtcctacctgtggaccgaatggctgacttcggtcgaccacaagaaaatcggcgtgatgtacatcatcgtcgccatggtcatgctcctgcgcggcttcgccgacgcgatcatgatgcgtacccagctggccatggccaccgagggttcgccgggctacctgcctcctgaacactatgaccagatcttcaccgcccacggtgtgatcatgatcatcttcatggcgatgcctttcttcaccggcctgatgaaccttgcagtgccgctgcagatcggcgcgcgtgacgttgcctatccgttcctcaactccctgagcttctggctgctggtttccggcgtcgtgctgatcaacctgtccctgggcgtcggcgaattcgccaagaccggctgggttgcgtatccgccgctgtcgggcctgcaatacagtccgggcgtgggtgtcgactactacatctgggcgctacagctatcagggctagggacgacgctgacgggggtcaacttcctggccaccgtgctgaaaatgcgtaccccgggcatgaagatgatggacatgccgatcttcacctggacctgcacctgggccaacgtgctgatcgtggcttcgttcccgatcctgaccgctaccctggcactgctgacgcttgaccgttacatggatttccacattttcaccaatgaacttggtggcaatccaatgatgtacgtgaacctgttctgggcttggggtcaccctgaggtgtacatcctgatcctgccggcgttcggtatcttctccgaagtcatctcgaccttctcgggcaagcgcctgttcggccaccactcgatgatctacgcttccggcgcgatctcggtactgggcttcatggtctggctgcaccacttcttcaccatgggttcgggggccagcgtcaacgccttcttcggcctggcgaccatgctgatttccatcccgacgggggtgaagctgttcaactggctgttcaccatctaccacggccgtctgcgtatcaccagccaggtcctgtggaccctgggcttcatggtgaccttcgccatcggcggcatgaccggcgtactgctggccatcccgggtgctgacttcgtcctgcacaacagcctgttcgtgatcgcgcacttccataacgtgatcatcggtggtgccgtattcggctacatcgccggtttcagcttctacttcccgaaagcgttcggcttcaagctgcacgaaggctggggcaaggctgcattctggttctggatctcgggcttcttcgtcgcgttcatgccgctctatgcactgggcttcatgggcatgacccgtcgtctgaacgctactaccaaccctgagtgggtgccgtacctgtacgtcgccatgttcggtgcggtgatgatcgcgatcggtatcgcttgccagctgatccagctgtacgtcagcgtgcgtgatcgcaagcagaaccagtgtgtttccggcgacccatggaatgcccacaccctggaatggtcgacttcgtcgccaccaccgttctacaacttcgccgtactgccgaaggccaatggcatcgacccgttcaccgaagccaaggaaaacggtaccgcgtaccagaagcctgctcgctatgaaccgatccacatgccgaacaacaccgccaccggcctggtgatgggtgctctgttgaccgtcttcggtttcgcgatgatctggcacatctggtggctggcgatcgctagcctggccggtaccgtgatctatttcgtgatccacgcggctcgcgatgatcaaggctacatggtgccggtcgacgtgatcgaacgcatcgaagccgagcagcacgctcgcctggtagccgagaagaagattccggccaaccgtgtagaaacctcgttggaacaggcttaaaccatgtcgaacttagtgaccaatgctggacacacccatgtcgatgaccatgggcacgatgaccatcaccacgactcgggcgagatgaccgtatacggtttctggctctacctgatgaccgactgcattctgtttgcgtcgatcttcgcggtgtacgcggtactggtaaacaacgtagcgggtggcccgtcgggccacgacatcttcgaactgccttacgtgctcggcgaaaccgccttgctgctgttcagttcgatcacctacggcttcgccatgctggcgttcttccggggcaacaagaagcaggtcctgggctggctggccctgaccttcctgttcggcctgggcttcatcggcatggagatcaacgagttccacctgctgatctccgaaggctacggccctagccgcagcggcttcctgtccgggttcttcaccctggtcggtacccacggtctgcacgtgaccgccggcctgatctggatggcgatcatgatgtatcaggtcaacaagcacggcctgaccgcaaccaacaagacccgcctgagctgcctgagcctgttctggcacttcctggacgtggtctggatctgcgtcttcaccgttgtttacctgatggggactatgtaatggctaatgcacactcccatgacagccatgatgcgggccacggcagcgtaaagtcgtacgccatcggcttcatcctgtcggtgatcctgacgatcatcccgttcggcctggtgatgtacccgaccctgccgaagtccatcaccctgatgatcgtgctcgccttcgcggtgatccaggtcctggttcacctggtgtacttcctgcacctggaccgctccgaggcccagcgtaacaacgtgattgcgttcgtcttcgctgccctggtgatcgtcctgctggttggcctgtcgctgtggatcatgttcagcatccacacgttcatgatggcgaagtgaggtaagacccgatgtcgctcaagcactttatccaaatcaccaaaccggggatcattttcggtaacgtgctttctgtggcgggcggttttttcctggcctccaagggacatgtcgatctggccattttcctggccgcgatgatcggcacgtccctggtggtggcttccggttgcgtgttcaacaactgcatcgaccgtgacatcgacctgaaaatggaacgcaccaagaaccgtgtgctggtccagggcctgatctccctgaaagtggcactggtctacgcgacccttctgggtgtcgccggcgttgcgttgttgtacaaggtggccaatccgctggcggcgctgtttgccgtgatcggcttcgtcatctacgtcggcttctacagcctgtacctcaagcgcaagtcggtgcacggtacgctggtgggcagcctgtcgggggcgatgccgccggtgatcggctacgtggccgtgagcaacagcttcgacatggccgcgctgaccctgctggtgatgttcagcctgtggcagatgccgcattcctatgccatcgcgatcttccgcttcaacgattacctggccgcatcgattccggtgctgccagtgaagcgcggcatcctggtggccaagaagcacatcctgctctacatcctggcgttcctggtggcgaccctgatgctgaccttcagcgggtatgccggcatgagctacctggccgtcgcggccgcgatgggcatgtactggctgtacatggcctggaccggctacaaggcggtggacgacaccgtctgggcgcgcaagctgttcgtgttctcgatcttcaccatcaccgcgctgagcgtgatgatgtccctggatttcaaggtaccgagcgagctgctgctgacctacgcgccataagctgcaaacgctatgaaaaagccccgccttcgagagaagcgcggggcttttttattgagtgtcagtcagtgggctgtttaaatattcaaatgactctattcatgcaggaagcagaatgatgaagaaaaaagccgttgtcgtatttagtggcgggcaggactcgacgacctgtctgatccacgcattgccgctctatgatgaagtgcactgcattacctttgattacggtcagcgccaccgcgcggaaatagaagtggcgcagcaactcgcgaagcaattgggggcaaccgtccacaaagtgctggatgcttcgctactcaatgaattggcgatcagcagtctcactcgggacaatatcccggttcccacggtgaacagttcaggtgaaagcctgcccagcactttcgtgccgggaagaaatattctgtttctgaccctggcctctatctatgcctaccaggtaaaggctgaaacggtcattaccggggtatgtgaaacggacttctccggctatcccgattgccgcgacgagtttgtaaaggccttgaacaaggccatcgagttgggcatggaataccgcctgcgccttgagacgccgctgatgtggctgaacaagtcggagacctgggcgctggcggatcatcaccagcagttgagcctggttcgcgagcagaccctgacctgctacaacggcgttatcggtagcggttgtgccaattgcgatgcgtgcaatcttcgtagcagagggctgaatgattatctggggaacaaggcggcagtcatgaacagcttgagaagcaagatgaacctgcaatgaaggcctgatcgaccgtgctcatggaattcaacactgcatttgcctggcagatgagtgttgaatccatccatttgagctaaagcgtgcttgtactattttgcctggctgtccgttatatatcttttgaacagtgaccttgctccataggctggcaagatgttgaagaatgcaaaacataccttgatcgcgatctgcacataaatcatgttcaggatgtcgttgttctgcatcgagccataaaaggcaatgtagcaaaacaggaagctgtcaataatgaccgcgaacagcgtgctcaagaatatccgcaggaacaggaatctggaattcgtcagctcttttatcttgcatagcaagtatgagtttatgttttcagaaaccaggaaagacacagaggacgccaccagcacggatgacacatgaatgatgacgtcgttgtacggggtgtcgagcttccagcctggcaggccggggagaaaggtcgagccatagagcaggatgataatcatggcgttgctggcaaaggcaaagaaaatcgcttttcttgccagcctgagtccaaaattttcgttcaacaggtcaacgatcaggaaggtcagagggtaaagaaaggtacccggagtgataatgatgccaagtgattcaagataaatgggcttggtggcggcaatgctggtgaatatataaaacgtaaagagcagtagattcaggatgatataaatcatccatgagctttcgtggcggtcattcaggtcgtatgcggtaagtgcccctccttgggagtagaacttcttgtagatgtttttaacttccattttgttcagattttccattatctcgctgttaagcacttcgcttaatttgatctttatgactttgcctgtggcgatgatcatgatcacggccaggttcttgttgttttcaaagcccagaagtttatatttgctgttctcgagttcgccttcataagctgccattgaatcgctcctcgatgatgtcacccaccacaaatactcggtctgagtcggagcatggctcattgatgatgaacagcttttttgtctgcctgtcgtaaaccagtttttccttgtcgtcggtcgatgtgcccttttgaatgatcaacaggtcaccggcctcgtacaggcccttgatctcattctccagcagcaccgctatcaagttgtaggatgcgccgaagtaataagtcagtgggtgaagtatggccagttcgccaatccgcttgtccatgttgatcatcaacaggctttccttgaggatcggaaccgccgccgggttcatgtttccttgtggggaaatactgctgtcgatgatttccttctcttcaaaatcgacggtttctatttcttcgtaggagacaccgaagaaatcggagattttgcggatggtggattgctgtacgttgctgaccttgccttccaggatgttgtatatggtcgttcgggtcaggccgctggcattgcacaaagacagttgcgtctcgccgcgactttttatcaggtatttgatgttgctcttcaaatactctgttctttctcttctgtgcatcaaatgctcaccatttccttatagtcgccacgcatagggtctttcatggaatgcgtgccgtgcatgacattcaactgctcgacgccaaaggtgagaacagtcggattgatgcggcaagagcttgtcgggttctttcgtggcctgtaccaactcgctagcactcctttagccagcctgcatccatcctgggatatttcgctgtcggtatggggcgcgctcggaattgtcgggagggtccggaccggaggcgccgcggcggcaagtgttgcatgtcccagtcatgacaataaagccccgaaatgtccggtgccctggcctcgattgacgaacattcagcggcaacgcacatctactgtcccctgctgattctcggaaaagaagcattttgtttggaaaatgtttaattctttgattaattagcggctcgcgaacgttaaaccaggaagcgtgctgtcgttcgtggcacgcaaatgacaaggaaggaataccgaacgatggcagcttatacagcaccactgaggaaccaggccgacctgctgcgacgaggtttggcggatctgcgggcagaagacgccgaactggctgggatcctggacgctgaagtcaggcgtcaacaccgcacactgtccctggtttcatcttcctgcgcggccaaccctcgaatcctcgcggcgtctgcctcggcactggtcaacgtcaccgccgagggcataccaggcaaacgccaccatgtcggctgcgagaacgtcgatctggtcgaatccctggcgattcgcagggcgcgggagctgttcggggcgcaatatgccagcgtacagtcgcattccgcctccaacgccaactaccaggtgctcgctgccctgctcgagcccggggacaccattctcggcatggccctcgatcatggcggacacctgacccacggcagccctgtcgcattcacgggcactcactacaaggcgatccgctacggcaccacatcgcagggcgtgatcgattacgcagaggtacgccaactggcgctcgcccatcgtccgcgcatcatcatctgcggtgcgacggcctattcccgggtcgtggacttccaacgctttcgcgctattgccgacgaggccggggccatcctgctggcggatatctcctctatcgccgggctggtggcaacgggtcgacatccgagcccgatcgacgtggcgcacgtcaccaccgcgtgtacccacaagcaactcgcggggccgcgtggcggcctcatcctttccggccgggacgcccataccaaggttcccggcctgagggcgagcttcagtcgtgtccttgagcaagcggtattccccgggatgcagggctcgccggcggtcaacatgatcgcggccaaggcggctgcgctgggctacgcgatgaccccggagttcgacgcctacatggaacggattcgcagcacggccgatgcaatggccagcgcattcatggcgcaggactacgaagtcgtgggcggggggacggagaaccacacggtcctgctcaggctgcgtgggggaattagcggttcgattgccgcctcggcactggagcgatgcggcatcatcgtgagtaaaaaccgcgcactgggggaaacccgatcctcattcgtcgccaatggcttgtgtatcggcacgggctccatcgcccaacgctacatcgatccccagggatgtcgtgaagtcgtcgatctggtctgccggatactggacaaggtgacgcccctcagcgagcagaagtaccgcctggagcctgagctgcaggaacaattccgtcttcagaccgaggcgttgtgcgcgatgtatcccatcgccgattaccggggcaactgaggggccccggcctttgattcgtaggagccagccggcgaagggcgcgctgcactgttgcccgatccgccgtctgtgcgagcaagcccgcgggtacgggttattgctgttgtagagcgctgtagccttcgaacgcggtctgctgctggatcgcggtgacgatgttcttgcgtgtggccggctgttcgttgccgtccttgtcgaagaacacttcgctttccagttccgcttcgtcgccttcgccgacaaaggcgaaaccgaggaactcgaaggcctcacggtcgacgttggccttggagcgcgggcggatcggcagggtgacgctgatgccgtccttgctgatggcgaacacttccatttccttcttggcccgcgaggccttgctcttgccgccacccgggctgctgatggcctggtgggtctggttcagcaccttcagcgccaggccgtagaccagctcctggaagctcgggtcgtccttgtagctggacaggatgcggctgatcgggaacttgctgctcaggtcttccagggcggcgctgtcggcggcctcggcgtccttgagctgtttgagctggcccatgagttcataggcgcggtcgtcgtcgaagcggtcgtgagcctggcggatctcggcgcgcaattcgcggatctggtcgctttccttggtggactggaaagcgtcgaggaccatctcgctgatggtcttggcctgggagacatgctgtgaaagattgatggcgttttcgtattccgctttggacgacaaggcgtttacggattcttctgtattggaatcggacattgatatttcactacttcgtttaactggaaatgaggctagaaaagcaccgggccttttcagggcgcctaatttatgggaccgaggccccattgtcacggaccaacggaccggtgcgaaaaggcgtggctctactgacccgcgatcgccgggaaaattccggcgccgatcatccctggcgagcgttcgcgggacaacgcctctgccgcatttccttcagcgccgcgcctgctggtgaaactcggcgaacgagaccatgcgctggcgcgccgggtcccacagtttgagccgcaggcagcggtagatatcccgcgggtgcagtgaggtggtgatcggcgattgcagcgcggggatcgccgccatggcttgcggcaggcggtagaaggggatgcccgagttggcgtggtgcacatggtggtagccgatattggcggtgaaccaggccatcagcgggccggtgcgcatgtagctggaggagaacaccgcggtggccgcgtagtcccagtcggcgcgctcggggtaacgcacgccggggaagttgtgctggcagtagaacatataggcgcccagcgccgagccggacaggctggggaccagcaccccgtacagcaggatgtccggcgccagcagcgccagggcgacggcgctcgccaggttcagcgccagggccagcagcgaccacagtcgatgccgcggctgggtgatcagcgagaccaggcagatgctgaaaataaagatactgaatgacgccagcaggatcatcagcgggtgccgggcgatgcggtagcgcaagcgcttgaggcgcccggcccgggcatattcctcggtggacagcaggggaaaggtgcccaggtcagtgtgagtagagagcagcggcaggcggtttttctccgcgccgacatactggcagctgtgcccgtggtggtaatcgtgggactgcttccacagcgtcggcggggccatcagcagcaggccgaaggtcttgaaaaacacctcggcaaaacgcgagcccttgaggatcgcaccgtgcatgtagtcgtggtacagcacgaacatgcgcaccagggacaagcccagcagcacgctgcaccccaggcgcagcggccaccacagcggcatggccacggccgcgccgaacagcccgatcaccagcagcgtcgagtagaaatgccaccagctcaggcggcggttttccacggtaaagggcagggtctggcgaatcagctccttgccataacgtgccagttgctcgcggtccaggccgtcggtgggccaggggatggcccccggctggtgcggtttctggcctgcgccggcgcggcaacaagcagaggcggtcgaggtgtccagcgtgcgcatgctcggtgctctccttagccgataaccgcttcgtcggggctgtgctgcaggaacagctgcggccgccggtccttccacggacgtgcctgttccaactggccggccaggcggaacaacaggccttcctcgccaaaggccgcgctgagcatcaggccgatcggcaggccctcggcgttccagtgcaacggcaaggaaatcgccggttgccccgaggcgttatggatggcggtgaacgggctgtagtcgatcagcgggccgtaggtgctttccaggtcgctggaatggatatccactacgccattgcgcagcggcggccgggccagggtcggggtcagccagcagtcgtaggtctggtggaaacgcgccatttcccgaccgacctgctgcagcaccagctcggacatctggtactccaccgcgctcacgccgaggccgcgttgatgcacggcctgggtcaggttttccagctcgccgggcagcgggccgcgtcccagttgcaggctcatcagttccacggcgaaggcaatgccggagaaccacagggcgctgaaggcttcggcgaagctttgcaggtccagctgcggcgcggcttcttccacatggtggccgagggattcgagcaggcgcgcggtgctttccaccgccgcgatgcagtcggggtgcagcggccgcccggccgggtcggtgctggaataggcgatgcgcaggcgccccggttcgtggccgagctggtcgagaaagcgcccctgcatcggcggcgcgcggtacgggtcgcccggcaccacgccgtgggtggcgtcgagcagggcggcgctgtcgcgcacgctgcgggtcagcacatgttcgtccagcaggccgctgagcagttcgccgaagtccggggccagggagttgcgcgcccgggtcggcttgaggccgaccaggccgcagcaggacgcgggaatgcggatcgagccgccgccgtcgttgccatgggccgccgggaccatgccggtggccaccgcggcggccgcaccaccactggaaccgccagtggagtattccaggttccacgggttgcgcgccgggccatggaaggcgccttcggtggtgggcagaatgccgaactccggggcgttggtcttgccgacgaacaccagtccggcctggcgaaaacgcttcaccagctcgcagtcctggggcatgacccgcgcttgcagcatgcgtgaggcgagggtcgaaggcaggtcctggcagtcgccgagaatgtccttgagcaggaacggcacgccgtgcagcgcgccggtcggcgtcgccttgtcctgtgcggcggcctgcgcccgggccttgtcgtaggctttgtagaccacggcgttgaccgccgggttgaaggcttcgatgcggcgtatggcttcctccagcagttcggaggggcgtacctgcccggttttgaccagatcggccaggccgaccgcatcgaaggtggcgtattcgctaaaagacatcctgttctcccgtgctgcgcacgctgctggcgataccggaacgctcccgctccggcctgggtttgatgacatggccggttgcacaggcccggcttgcacgggcctggatatcggcttcacatccttgaaaaaggctgatgactgcaagcggtatggcaaaaagccacgcatgcatcgagctgtgaggcgaatatgcgccgggggcggaaattgcgggtatacgccgttcggagtattaacttcgactgcgcgctcccagaggatgatcaagcgtaatggatgcgcaaggccgcagatttcgggccttgcgggagatggctaagtacggctgcctggacacaaaataatgactacgaacgaccacgatagcgacgttccgtatgcgaatttttcggaatgtctgcagcttcacgcccatatgatcccggaccgattggcctatcgttttctgcacaacgggcgagacgaagaaaccctgatcaccttctctgaactggaccgcgcggcgagagcggcggcggcccggttgcaggggcattgtcaggcgggggacagggtgctgatcctgctcaagccaggcctggactatgtgatcgccttcatgggctgtctgtatgccgggctggtggcggtgccggcctatccgccgggggcgaccaagaccctggaccggctggacggcatcatcgacgactgccagccgacggcggcactggccagtggcgaggatgtcccgaccatccaggcccggctggggcaggccgaaagtccgcgggtgctggacatggcgagcctcgacctggccttggccagcgagtggcgggccgtcccggtaacccgggacaatatcgcctttttgcaatacacctccggctccaccgggattcccaaaggagtggcggtgacccacggcaacctgattcacaattcgcgcagcatcagccgcggtttcctgacccacaaggacagccacctggtcagctggctgccgccgtatcacgacatggggctgatcggcggcatcctgcaatccttgttcgtcggcttcggctcgaccctgctggcgccgatccacttcctgcaacggccgctgcgctggttgcaggccatcagcacctaccgcggcaccgtcagcggcgggccgaacttcgcctatgaattgtgcctgcgcaagatcaaggacgaagagctggcgggcctcgacctgagcagctgggaggtggcgttcaacggcgccgagcatgtgcgggcgcagaccattgccgccttccatgagcgtttcgcccgcgccggttttgccagcacctcggcctttccctgctacgggctggccgaaggcacgctgatggtcagcgccggcggcagcaagcgcgagccggtgatccgccagttccatgccggcttgctggaggacaatgtggcacgcctgcatgaaggcccgggcagcgacgccgagttgcgcctgcgcaccctggtcagcagcggtcgcggcattcccgggcagggcccgttcatctgcgacccgcacaccgagcagccgctggaggacgggcgggtcggggagatctgcatcctcggcgacagcgtcgccagcggttactggcagcgcccggagagcaccgccgcggcctttcgcccggcgccgccgacgctcggctggtcgcgctactttcgcaccggcgacctgggcttcctgctcgacggcgagctgttcgtcaccgggcggctcaaggacctgattatcgtcaatggcgtcaaccatcatccgggcgatatcgagaacaccgtgctgcgtacccatgacagctttcgcccggacggcaccgcggccttcagcatcgagaccggcgacagcgagcaggtggtgatcgcccaggaaatcgaacggcgtgccttgcgcagcctcgacctgccgcagctgttcagcgacttgaaagcgcggctgtggcaacagcaccaactggcgcggccggtgctgttgctggtgttcggcgggtcgttgccgcgtacctccagcggcaagatcaagcgccaggagtgccgcaagcagttcgctccctggctggcggcactcgatggagccgcgccggccgaagcccacccgctggacaagtcggtgatcgcggtggagagcaacggccgggtattgcgtgacatcaccgtcgacagccaggtcgtggaagcatgaccagtctatcgatcggcccggtgcatgcgcccaagcccgcggcgctgctgttcgcccagccggccttctgcgaaccgcggctggaactggccagccgcccgcggtcggtgctgtcgttgccgcccaccgacagccagcaacggctgcagctgaccagcgtgctcaactccatcacctcggcgcgcagcatcgccgagctgacgcagcagacccagctggcgctgccgcagatcctgccctgcgagaacttcgtgttcgccagcggcagggtccgcgcgcaccgggtgttcttctcgcacctgattcatccggacagcgtctccgatgacctgatcaaggccatcgtcggtcgcgacggcatgattccgccgctgggcatcgatcccatcgagcactgcgggcgccccaagttcaccaccctggagcggctgggcaactcgtcggaccaggtgtgggcgaagatctttcgcgaacatggcatacgcaacctgggctggaccctgctgcccggattgcaccgcaacaccttcaccggctacttctttcacaacatctcggccaccgtggcccatgaaagcaaaatgcgcatgatggtcttcgccccgtacctgcacatcgccctgaaccgggcgctgggcagcaagctgttgcgccacaacccggggccgaaccatcaactgttgtccatcctgtccagccgcgaagcggagatttcgcgctgggtggcccgaggcaagaccaactgggagattggccagatcctcggcatcagcgacaagaccgtgaaaacccatctgcagaacatcttctccaaactccaggcgtcgagtcgggcgcagatcgcggcgttgttctgcgacgagtgagtgctgcctgcctgtctttcatccggtaacccttccacagtgctgacgggggtcagtgctttggcgtcgcctgcgcctctgtaggagcggccggtcgacgcccgattggtcgtgatggtgtctgtttgggggctgcattttttggatggtgtacatatccattcttggctggcggcagggggaggcttctgtaggagcgaggcttgcccgcgatgacgatggtggcctcactgctgatgttggtcggtgtacatatccatttctgcggtaacggccacttagggtttcgcccttacggcgactcacttttttcagacgccaaaaaagtaagcaaaaacgcttgccggtatgactcacccacataggtaacagaaaagttcaagcacataggtaacagtttttaactggcagggtcgattccgaggagctgaccatgccgtggcgagagctgaaccctatggaccttaaagtgatgttcattgccgactatctgtcgagacgctttaacttccgcgaactgtgtgcggcacacagcatcagtcgaaaaacgggctacaaatgggtagcccgttacaacgcagagggtgtgcagggcttggatgagcgcagtcgcagtcggcatgctcaggcacatatcattccctttgaaatcaaagcctcgatcatcgagttgcgctccaaaggacctacgacaccgggccccaagaagatccaggtggctttggctgagcgttttccagggcaggagccgccctctaaaaccagcatctacaacatcctcaagcgggctggtttgataacgccaagacgcctgcgtcagcgtgttgcaatctacccaattccgttgaagagagcggacctccccaatcagctatggagcgctgactacaaagggcaatacctgacaggagaaggcgtctggtgttaccccttgacggtcatggaccatgcgagccgttttctgttggcctgcgagagcatgcccagcaccaacttcaaagacgcccaaaaaacgttcgaacggttgttcaaaacctatgggatgcccgaacgcattcgcactgacaatggtgttcctttcgccagtgcggggcgtgcggggttgtcgctgttgtcaatttggtggctacgtctgggcatcattcccgagcgaatccaaccgggtcgacccgagcaaaatggtcgtcatgaacgcatgcaccgcacgctgaaaagcacgctggtcagtcctccggaaattgaatggggcgctcagcaaaagcactttgatctgttccagcagcactacaatcatgaacgaccgcatgaggcgcttgggcagagaacaccggcctcctgttattgctgttcggatcgaacttatccggcacggctaccagtgatgaggtatcccagccatatagaaacctatgtcgttgactcttgtgggatcgtcaacagaggtcggctcaggatctatgtcggcaatgtgctcaagcgcgaaacggtaggtctggagcgtatcagtgagggtatttgggacgtcatatttggcccgatcaagttgggtcgctttgatttgaaagatgcccaggacggttacatcaggctcagtccggcgtcataggcctgatttggtgttacctatgtgcctgaacttttctgttacctatgtggttgtcccgttcatgcccctgcgtacggccttcgctgcgctcaggttccctcgctccggcgtccatcagggggcatcgactccggtcggcttcgcttcgacctccatacgatgtcctcgactgcgtcgaggggcgctgtgcgccatccccctgatgaacacctccactcggcctcccgatggggcgggtagatcaaaagccaaagctgcgccatgcgcgacctaccggtcggcgctaaattttgtagccgctgccgagcctgcgaggctgcgatcggccgcgaagcggacgcagggtcttgataccgtcggaggaccttcggtcctatcgcagcctgcggcagcggctacagggctcgctactccttacggagtattgagctgagccggcatgacgccgagcatcggggtgtagcaaataacctgctccgtcgggttatccacactcaaaacgcgtttgcatcatgacgcctgcccaagcgttgatccgctggtttcaccacgcggttggcgcgggccaacggccatgcaaaggaagcgaaatacgctgggaggcgactgtgcacatagacgaaataacctttgccgtgaccgaaaccctggccagcctgctggaggtcgattccgggttgctggacgtcgagcgctcgttccacgagatgggcgtcgactcggtgctgatcgtcggcctgtccgccgagttcgaggaccgtttcggcatctccctggaccctgagctggcctacctgcacgacaccgtgagcaaggtcagccagcacctgtacggcgtcatcaaccagggcgcgctcggcgcggtgggggaggtcagtcatggctgattcattgctcaatatcacccgccaggaactgctggaattcgtcggcctcaacgagaccgtggtgcgcgcccagggcacccgcatcgagaccgccagcggccagaccctgatcgatttcgtcggccagttcggcgcggtacccttcggttatggcgcggcgcctgttaccgaggcgatccacacctttctcgccagcggccaggcctcgctggtccagccgctgatcaaccccggcgccgaagaactggcgcggcgcttgatcgagctggcgcccggcacccactcgaaggtgaccttcaccaccagtggcgcggagaccgtcgaagcggcgatcaagctgtgccgcgccgcgacccagcgcgaactggtgatcggcaccctgaccggttttcacggcaagacccagggcgcggtcggagtcaccggcaaggccacttaccgcgagccgttccagatccgcgccgacggtttcagccatgtgccctatggcgacctggaggccctcgaggcgctgctgaaaacccgacgcgccgcggcctttttcgtcgaggcggtgcagggcgaggcgggcatgatcaccccgccgccaggctacctgctggcggcgcagaacctctgccgccaatacggcaccttgttcgtgctcgacgagatccagaccggcctggggcgcaccggcgagctgttcgccgccaccgcccacggtctggagccggacgtggtgctgttggccaaggccctgggcggcggcgtcgcggccatcggcgcgtgcatctacggcgagcagtgctggagccgcgatttcgaccggcaccacagttccaccttcgccgtgaacggcttcagcgccgccatcggcctggccgtgctcgaccagctcaccgccaacgacggtgcacagctcaagcatgcggcgcagcagggtgcctatctgtacgccgggctgtcgcggctggtgcaggactatcccgaagtgttccacagcctcgacggccgcggcctgatgcttggcctgaagttccggcgctggagcggcgagcgcctgtatacgctgtccctggccagcgctttcggcgccctggtgccgatcgtctgcggctacctgaaaagccgccatggggtgtactgcctgccgaccctcaccgaaggcaacgtgctgcgcatccagccgccgctgtgcatcgagcgcgccgacattgacctgctgctcgaaggcctcaaggcggtggcggaactggtggtgcataaccagcaacaccggttgattctcgaagcccacggttatgccgggccacggggggccctgagcccctggatcgcaccgggcaaaccacgcagcagcgggcgttgcctggggcgcttcgccttcctgctgcacccgaccaccgccgagagcgtgaatggcgacagcgtggtggatggcctggggctgtcggcagcggaaaaaacctttatgcagggctggctcgacgacttctccgaatgggccaagcccgacctcgacgccggggtgtcctatcacgcccgccgggtctacaacgatgccggcgactacgtcgaaggctggctggtcggcagcctgctgcaaccgcgcgacctgatgcgcctgagcctgggcaagcggcgcaagctgctggccaactacctggacagcgtcgccgagctggaggtggatttcgtcgggctgggggcctacacctcggtgatttccagtgccggcgtggatgtcatcaacgagcggttccacaccaccaccggcaacagcctgacggccatggtcggtgtcgatgcgctgctgagcacttgcgccaaccgcggcgcgccgctggccaagcgcctgaccggggtgatcggtgcctacggttcggtggggcgcctggccagcctgcgcctggggcgcttctgcgagcacctggtattgctcggcaatggggccaatcggggcgccatggacgagctacggctggtggccggcgagttgtatcgcgatgccttgctgcagatccagggtggccacagcggcggcatcgccaagaccctggtgctgctcctgccgagcctggccagcgtcgagcaactgctggatcgcgaccttggcgatgaggagcaattgcgcacgctgttcgacagcgtcgatgccctggcccagggcaagccgcaggtgcagccgccgctggtgatcaccgcggatctgggccactggctgccgcgcctggaaaccgtgctctcggcgacctccaatggctcggcctttatcgacccgctggtgctgcatcagaacgcgatcatctgcgactgcgcgcagccaccggacatcggtcacgtcaccctggcgctgcgcccggacgtcacggtgatcgaaggcggcctgatccatctgcccgaccgcagccagcgtttcggccaacagaaccttaccggtctgcccacgggcgtgaccttcagctgcctggccgaaaccatggtcctgaccatggccggcctgcggcgcgactacagcatcggcaagcgtcctccactggaggatgccgaagcgatcttcgacctggcccgagccttcggtttcgcccccgcggtggagcagttgatcgaaaaagccggttaaccctgacaacgagaaaggagtccacaccatgtcgatgcacaacgcccgcaacgccaccgagaagtacctgccgggcctgctcgccgccctccgggagcgtggcctgatggccctggaacaggccgacccagccgtgctctgcgggctgtttcgcgactaccgtgccgccggcctgatcatccccgagacctacggcggcctcggcgcctcgccggaggaaaccgtggagatcctgcgcgccatcggttcgctgtgcccgtccctggcggtgatgatgaccatgcaccaccacaccatcgccaccatcgtgcaactgggcgggctgatcccggcggcggaagagctgctgtggggcatcacccaggaccagttgctgatcgcctcggccttcgccgagggcaagccgggctcggagatcttcaaccgcagcgtcaaggcgcggccggtggagggcggtttcgtcctcgacggcagcaagaagccctgcaccatgagccaccacatggatgtgatcgtggtcggcgtcgcctgtgaacaggatgacggcagcatcagccagggctttgccgtggtctttgccgatggcagcacggtcacccgcgaacccttctggaacgccacggtactgcgcgccaccgacagcaacgaactggtgttcaacggcgtgttcgtgcccagcgagcgcatgctgctggccgacggcgccgacagcgaggaagtggccgccaccgccatggaaacctcgctcaacggcctgagctggtttcagctgatggtcggcggcagctacctgggcgtggcctcggcgctggtcgaccggttgctgagaaaagccttcgccgaccccgcgcaactggccctgctgtgcatcgagttggagggcgcccatcaggcgctgctcggcaccgccggcgaattgcaggcgcaacaggatgcgccgatgaacacctaccacaaggcgctgtgcacgcgcttcctggtgcaggcggcgatcgagcgggcaaccaacctcagcgtcgagctgttgggtggcatggcgttcatcgcctccgacgaagtggcctatctgctggcggcctcccgggcgatcggcttccacccgatctcccgcagcgccgccacgccgttgctggcgcagttcctgcgcgagtcctacagcgcctgattcgcctgctaccgcagccggagcttcggcgcccctggcgtcgctccggcctcggcaacatgcctaatggagtagaagcatgagtagcgattttctctatccgccgcgcccggccaatgtcggtcgcgggtttcactgcctggctgttccgctgttcagtctgctgctggtgttcaacaccgcggccatcgtcgtgattctggccctgtcgtgcaccttgcaggccgggcgccggtcgttgtcgtggctgccgggaatgaaggctctgggtaactggctggtgacgagctatcaccgcttgttgcagccactggccgaccgcttgctcaaggacccgcgggacgagccgatcctggccgccgccatcagcctgggcctgaccgccgggccggtgttcattgcccagctgtggctcaaggaaatctcctggctgctggtgctgctgttctacgccttcgtctatgggccgaacattcgcggctttgtccgctccttcagcgccatgcatcaggaaggccacgtgcccggtggcatcttcaagcgttcgagcctgctcgatcgctgggtcggcaattccttcctgtacatgttcttcgccattcccatgggcctgatcccccatgcggcggcgcacctgcaacaacatcaccgggaaaacgccgggccgctggatgtctacgccaccgcgcgctacgaccatgccagcgcctgggatttcgccgtgtacatggtgcgcgaggtgatgtaccagcagttcatggtttcgccctggctgtacttcaagagcaaacacaaacgcagccaggcccgggccatggtcatgggcaacctggtgcatgtcgggctgttcgtcgcgctggcgtgctacagcctgccgatcgcggtgttctacatgctggtgccctggtgcgcgagcaacttcctgatgggcgtcatccactggagccagcacgccttctacggtggccagcaagaccccaaggactggatgtacaacaccgtgaccctgctggaaacaccggtgaatatcctcaacgagggttaccacgcctgccaccatcactggtccgtcggccactggtcggagagcccggtgctgttcgagcggctcaagccggaactggcggccgcgggttccatggtgtttcgcgacctcagcgtattcggcctgttcgtgctgctgatgctgcgccgcttcgatgcgctggcggacaagctcgactggtggcagccgctggaccacgcagagaaagtccgcctgctgcaattccgggtgctgccggcgcccatcgcggcccatgaacatgcccatcaacggcgcctcgccacaccgcgcaacgccgacgaacccacccccgcgcacagcgccctgggccagccatgaaccgtcccctgaccttgaaagtcgccgccatcgaacgggaaaccgacgacgcggtgaccattcacctcaagcagccgctgctgcgcaaagttcgctacagcgccgggcagtacctgaccctggaggtcgacgtcgacggcgccaagggttgccgcgcctattccatcagcagcacgccggggctggacaagaccctgtcgatcaccgtcaagcgcgtggccggcggcaaggtttccaaccgcctggtgcaggaactgagcgccggcgacgcggtgcagaccctcggcacccacggccgcttcaccttcgccccgcagccgggccgggggcggcacctggtgctgctggcggcgggcagcgggatcacgccgatcttctcgatcctcaagtcggcgctgcacttcgagccggatgcccaggtgtcgctgatctacggcaaccgcaatcaggagtcggtgatctttcgcgacaagctcgaccagttgcgccagaccttcggcgagcgtttgcaactggtgcatgtgctgtcgcggccggacgccccgggggcccacgaagggcgcctgacccggcagcgggtgatcgacattctcggcgcgctgcccggcccgcaagcccgcgaatactacagctgcggccccagcggcatgatggacgaggtgaccgccgccctggaggccctgggcatcgccccggaaagcgtgcaccaggagcgtttcaccccggccaaggcgccagtggccagcggcgacacggagaaacgcgtggaactgctgatgcagggccaggcgttcagcttcacggtcgccccgggccagaccctgctcgacgcggccctggccagcggcgtgcagccaccgttttcctgccgcagcggtttctgcacggcctgcgtctgcacccggctggcggggcaggtacgcatgcgcgaggaccatgggctgtcggcggacgaactgaaccggggccaggcactgttgtgcgtgggctatccattgacggacgacgtgcgcctgcaagtcgattagcgatacagacagaggaaggtcaattcatgaatcattcaacccaccacgccgccgaggacgaactgcggctggccaagcgcgccgaactgcgggtcgaccgcgagcgccaggcccagctgcaggcactgatgcagccgcagccgctgaagttcgtgctctggtcggtgctgcatgtgctggtctggtgcgcggcggcgctgtacatcctgctcggcgacaacccctggggcctggcgctggcggtgctggtgctgggcaaccagctgcatgccttcaccgtgctgcaacacgattgcgggcatgccagcggctttcgttcggcggcgctgaacctgtgggtcgggcgcttcatggcctggttcattgtgtttccgttttcctccttcaccgagtgccacaagtaccatcaccgttacctgggcgatccggacaaggatcccgacgactggaactacaccggcggggtgaagtggatgttcctgcgcatcgccgtgttcgtaccgcgcttcatctacttttccctggtgcgctacggcaaggcggtgcgcaaccgggtgctgcgcgagctggcgttcaatctgctgtcgctggcggcgatcggcgcctggtgctacagccaggggctgatgctgcaattcgtgctgattttcatcgtgccgctgctgttgctggcgctggtgatcaacccgatttcccgaggctacgagcacttccccatggccaccctggcggttggcgacccgcagcgcctggacctggcgaagaacaccgtgaccgtcagcgaccggctgatcggcctgctgtgggccaatatcaactaccacgtcgagcatcacatctaccccggcgtgcccttcgtcaacctgccgcggctggcggcgctgctggacaacaagccctacctgcgcgaccgctggctgctggcgcggatgttcgcgcgacgtccggtaacaacttgcgccgaacctcggcgagcggcgtgagctacatttacagcgcccgaaggagcgccacccaccgaggattcacggatgacctgtattttctgccagatcgcggccggcgaattgcccagtgccctggtctatcgcgacacccactgcatggccttcatggatgtgcatccgctggggcagggccacttgctgctgatcccgctggcccatgtggaaaaactcgagcaactgcccacggtcatccgccagcacctgtaccaggtgttcgataccttgctcgccgcccagcggcgcgccggcttcggggtggaaggcacgcacctgatcgtcaacgacggcaaggccaccaaccagcacattccccacgcccacctgcacctggtgccgcggcaaaggggcgatgggctgggtttcggcctgcgcatgttcatgcacttcaccggcctgttcggccgccgcacgcccctgcagaccctgcgccgccaggccctggtgatcgccgccgaactcgacccgcaggcgctggagaacctggcgcaccggaccagcaggctgcacgcaacgtcaacctaaccgccagggccggtgagcggcccaccctcgatccacagaacttcggaatgaacagccgtgcatgcgctgcgggcggtttcgcccggcgtttgtgccgccaggagtcaggaacatgagtgcgctacttcaggagcaggccgatccggcgcgggtctatcgggtcgtgatcatcggcgccggcttctctggcatcggcatggcgatcaacctgcgccagcgcggcgagcgggacttcctgatcctcgaacaggaagccggcgtcggcggcacctggtgggtcaatcagtaccccggctgtgcctgcgatattccttcccacctctattcgttttccttcgagcccaaccccgactggtcgcggcgcttttcgccgcagccggagatccgcgactacctgcggcgctgcgccgacaagtatcaggtgctgcaacactgccgtttcaacaccgcggtcaccggcctgcgctggctggaagagcgcgccctgtggcaggtgacggatgcccgtggcggcgtgcgttttgcccaggtggtggtggccggcaccggggccttgtcgaccccggactatccccgactgccggggcttgagcgcttcaagggccggatctttcattcccagcattgggaccatgactacgtcctggccggcaagcgggtgggggtgattggcaccggcgcttcggcgatccagttcgtgccgcagatccagccgcaggtggccagcctggcggtgttccagcgcacgccaccgtggatcatccccaagccggatcgggtgttttccacgactgcccagcgtctgctgcggcgttttcccgcggtgcagcggctgttgcgcgggctgatctacaccgcccatgaaacccgggtattgggcttcgtgttcaacccgcggctgatggccctgcacaaatggctggcgctcaacctgctgcggcgccaggtcaaggacccggaactgcgccggcgcctgaccccggactacgccatcggctgcaagcgcatcctgctgtccaacgattattttccggcgctggcccaggccaacacccggctggtcaccagcggcatccgtgaagtcaccgaggacgcgctgatcaccgtcgacggccagcgccatgccctggatgcactgatcttcggcaccggcttcaaggcgcgcacgccgttcccggcggggatgatcctcgggcgtggcggggtggacatagtcaacacctggcagcagggtagcgaagcctacaagggcaccacggtcagcggctttcccaatctgttcctgctgatggggcccaacaccggcctggggcacaactccatcgtctacatgatcgagtcgcagatcgcctacatcctcggcgccctggacactctgcaacgcctgggcgtgaccagcgtcgatgtcgatccgcaggcccaggcgcgcttcaaccagggcctgcgccaccggctgcgcggcgcggtatggagcgtcggccattgccagagctggtacatggaccccgacagcgggcgcaacgtcgccctgtggccagggttcagctggcagttccgccagcagacccgttatttcgatgccgaggcctatcgcctcacctcgcatccccaaggagtgaaaccatgagccatccgggcaagagcgtgtttgtgttcggcctgtacatgttggtgctgggcgccgcgttggtgctggcgccgaacctgttgctgccgttgttcggcttcgccctgaccgatgaggtgtggatccgggtaatgggccagttggccttatacctgggcgtctattacgtctgggccggctacaccgagcggcgcgagttcatggccctgaccgtggcgatccgtctgtcggtgccggtgttttttgccgctttcgtcgccgccgggctggtgtcgccggtgctgttgctgctggccttgccggacctgtgcggcgcgttgtggacctggcgcgcgctgaaatccccgatggcttcccgccagccattgggggacgcctgagccggtgctgtgtatcgagcactcgccagttaacccaggtggggtatttctgatggccacgcggttttcgctggagcgccgccgcggaaagtgggacggggccgtttatggcgccaggtcaagagcgagagccaagcctgggtgggagggggagcaatgctggccagggggcaagcaagaagggaaggagcagaactggctacatccgtgtagccagttccgaagggtcggtactacgcattgttcaatgaagctcctgagcaaagtcgcagtgagccaggcgggatatctcgattcatatccacaacgggttcttcatcgaactcgaacccgctgcctgaacgccctgtgtcgctattacttgagcgttacatcgagcatcggcgggatgtaaccgtagtcgtactcggccaccacgaaggtctgttgccctttgatcttgatcccgaccgtcggtgcttcggtaccaccgatacgaatctgcgtgccgctttcgtcggtcggtacgctgtcgataaaggaggtcaccaggccgttgggcatcacacagtgcgagtaggtctggaacggctgggaggacgggttgcccagcaccaggccggaaccgttcaacggcacgtagggaccgaacagcgagtcggcgacaaaaccgtacaccccgtccggcccggtcacgccgtcggcataggtgaaggtgtggctgatggtgaacaggtagtacttgccgtcctggaacacgaagtgcgggcgttcggtctggtcgttgacgccgaccgcggtcagcagcggcggcagcatttcccagtcgtcgccgtcttcgtcacgggccacggcgataccgacgcaggcggtctggaaacgggagttgccgacgtcttcataacctggcggcacgtcgccgatttctgctttgcccactgtgtgcgagccgcgctcgccggccacgttgccttcgaacagcatgtacagcttgccgtcgttggggtcgcggaacggccatggatcgcggaagccccagaaggggttctgcgcttcggtctggtacatcttgccgtcggcctcgaacagcggcttgaccttctcgaaaccgaccatgctgacgccatgctcggtggtcactacccggccgcgcaccttgacgatggtcgcacccggcgtgacggcggtgtagtacaggtccacttcaccctgttcgttcaacaggatcggcgtgccggcccattcgcgagctgtgggcgaaaccccttcggccatcacccggccacccagctcccaatccttgccggtacgggaaaaccagtagtacatctttgcccggccgtggcggtcgttccagtcgcgggtgatgtcgtagttgccgttttcgtcgatgtactgcgggtcgttcggatgacgatccgcggtcagggtgaagatcaccgaccagccgtcgacggaggttatgtttccgtccaggtcgcgcagcggcatggtgtcccagatgaacacctcgttgctcagtaccgggaaatccgcactgaccagtggctgggtcgtggtgggatcgtccgcatggactttcagcgcatcggcgcgagtccagaggctgggttgatggggtgttttgccgaatttttcagtgttgcttttcataggtaatacctcgtccgtgaatggattcacataaatgttcatcaaaaatactgtatttgcatacagcgatttcaccttaagcgaggcggttttttgggtcaagaataaatttgcatttatgcatatttgctgtttttgctgaagctgatacgtttcagcttgttctgtttctagaagttcgttttccgcccgatcaacgacgatgcctgcaaaatgcgcgcttgaaaccgctggtcggtccgagggcgcagaaggggaaaagagggaggcggaacaaggtcaagggcgggaaccgagcctgggcggatcggtcaatgccgccgagcgctgcgaacattgtcgctgtcatggcgcggacgtagcctgagcccttcgtcgcctggatcaccgtcagcagaggggataggtcaatgaagggtgctatcgacgcatgggcgcaaccggccaacggccgggcgcggcagttgttgccggaagtggcgcggctgttcgagaagtcgggttcggcgcattggctggaccagccgctgagcatcgagcagaccgtcgagctgatggaccaggccggggtcgagaagctgatgttggcggcctggtgccggccggagcgctgggtgttcagcaacgatgaaatcgccgcgttcacccgcgcctatcccgagcgtttcgtcggcgtggccacggtggacctgagccggccgatggcggcgctggccgagctggagcgggcggtggacgagctgggctgcaaggccctgcgcatcgtaccctggctgtggaaactgccgcccaaccaccgcctgtactacccgctgtacgccaagtgcgtggagctgggcatccctttctgcacccaggtcggccacaccggcccgctgatgccttcggaaaccgggcggccggtgccttatctggatgaggtggcgctggacttcccggaactgcaaatcgtcgccgggcacatcggccacccctggaccgacgagatgatcggcctggcctggaagcacgacaatatctacatcgacacttcggcctacctgccggcctattacccgccgcagctgctgcatttcatgcgcacctacggacaggacaaggtgttgttcggcagtaatttcccgcagctgccgttcgccaaatgcatgcagcaggtccaggccctggagctgccggagccggtgcgggacaagttcctgcagggcaatgcgcggcgggtattcggcttgtagcgcagcgcctcaggcgtggtcctggtagcggcgccggctgaaaaacagcgagctgcccatggccaccagcgccacggcaatcagcccggcatcgatctcgcccagcatgggcggcaggaacagaatccacagcagcccggcgaggcccagggccaggcctgtccacttcctcagcgggtaaggcttcatccagtagtacagcggcgtcagcagcaggtagaccagcacaaagggaatgtactgcttcatgagtcttgctcgccgcggccgaagattcctgggctggcggccgtgggccgctctctgtagttggggcatgtcatgttgcacttccttgtcgatggcatgaggcgcgccagtgtccatggcgcgcggcttttgtgcaaacgcgtggtgtcatgccaaccgcgccaggcaaccctcgagaatatccagcccttcttccagcacctgcggctcaatggtcagtggcgccagcaggcggatgatgtgccgcgacttgccgctgggcatcaacagcaggccggcgtcccgcgcggcgctgagcagtgcgctcagttgctccggggccggcgagccgtcggccttgaccagctcgatgccacgcatggcgccgaccccggtcaggcgccctaaataaggtgtcaggcgctcggcccgccagcgctggtagcggctgacgatggcctgctcctggcgttcgccccaggtttgcagattgtgatcgctcatctcgtccagggtcgccagggccgccgcgcaggcgatggggttgccggaataggtgccgcccaggccgcccttgggcaggttgtccagcagcgccttgcgcccgagcaccgcgcccagcggcacaccgccgccgatgcttttgcccagcaggaccaggtccggttcgatccccagccgcgagaaggcgaaccgctggccggtgcggccgaagccggactggatttcatcggcgatcagcaggatgccctgttcatcgcagaagcgtcgcagggcacgggcgaactcgacgtccagggccaggaaaccggcctcgccctgcaccggctcgacaatgaagcaggccacttcggcgacgtcgatctccacgctgaacagccggcccatggccttcagcgcctcctcgcaggtcacgccgttgtccgcgctcgggtagggcaggtgatacaccgggccgggcagcacgccgatcttctgcttgtagggcgcgaccttgccattgaggttgagggtggccagggtgcggccatggaaaccgccgtcgaaagcgatcaccgcggtgcgcccggtggcgccccgcacgatcttcaaggcgttctccgccgcctccgcgccgctgttggtgagcatgccgctgaccgggtaactcaagggcacgaagcgcgccagccgctccatgaactccacatagggcccatggggcgccgcgttgaatgcgtagtgggtcagccgggtggcctgctgctggatcgccgccaccacccgcggatgacaatgccccaggttgagcacgccgatcccaccgacgaaatcgatgtagcgcttgccattctcgtcccacacctcggcattcttgccgtggctcaggcggatggggtgaacgatggaaatcgactggctgatgctttcgctgctcatgggctaagggctctgtctgcctggaacatgcgggctatctaagccaagagcggggtggggccgcaaacgaaataaagtgcgggggtcagtatgaaaattccggatgttggattggggcgggatcagtcgttaagcggcgcggcgttcctggccctggcccggcgctgacgcagcagggcgatcagcaccaccagcaccacgacaccgaggacaatcggcaggcgataaggcttcaaatcaccgaacagatgctccagcgcatcgccggcccagtagccgccgcagacgaacagcgtggcccagagcagtgcgccgagcatgttcagcagggtgaaacgcagcggcgacagaccgctggcgccgatcaccaccgggccgacccagcgcatgccatacatgaaacgcaccgccagcaccgaggtcgaggggtaacgccggatcagcccggtcacccgctcgatggcggcctgctggcccttcaggcgcggcaacaaacgcccgccgaaatgccgcccgctccagaacagcaactggtcgccgaacatcccgctgaccgtggccacggcaatcactgcccaaagatccagcacttgctgatgcgccgccatgccgcccaggatcagcacggtttcgccttccagcaggcagccgaggacgatcacccagtaaccgtaggtcgcgagcagggcatgcaggtcgaggtgttcgaacatgggaatgaaagggcctttgcagaagtagtccgtaagctttagatgcgccgagattgctcttggcctgcccaagcataggggaaaagtttgcctgatcgttgacctgtcggtgacgcgcgctaggctggtggctctatttgaaaacgccaggagatagctcgatggcgcaaggatcagtctttagaaacagcagcggtcagactatttacctgactgaggctatggcgtttcctggcgatgttacgcaagtggagatcatcgctatggggcgtacccgggtcatcgctccggctggagaagcttgggacagttggtttgatgaggcttctgtgagtacggactgtatgacggacagggatcaacctgctgaaccgaaagacgtctgagcgactcggtttttgccaagtcgctctcacccttcagtcttcctccggcgccagcatccgggttttcggcgcgccattggcgttgtgctggtagatctcccggggctggccgttgtcgttgaagaacacctggccaatgcccgccgagttccacagccgttcgccggcctcgcgatgttcggggctgtagggcaccactcgcatcagccggcggcgggtgaaccagttcaacggcgagcgtggcgaatacagccagcggttgaggcgatcgaaccattccagcagggtcggtggaaactcgttcttgatgccgctgctggtgatctgccagatcttcgggccgcccttgcggtggcggatcagcacttcgtagacgaaggagtaatgcacgtcgccggagaggatcacgtagttacccggggtgcgcgagtggcgaaagatattcaggatcacctgggccgcgccgcggtgggccatccagttttccgcgtccaccagcagtgggtgaccgcaccagctgaagaccttctgcaccgtctcgatcagcttgacgccgaacaccggcgccggtgacacgatgatcgccgacgggtgatccagcagttcatgttgcagctcgctcagggcttcccagtcgagcaggcccgagggctgcgccaggttgaactcgctgcgccagcgccgggtgcgggtgtccagcaccaccagcgccggggtggtgggcagggtgtattgccattgctggaagcgcagtaattcgtcgatcagggtgtcctgggtggcgctgtccaggtagagcgcatcgccctgggcctcggcgctcagggcgcgggtgtgttgcagcggcgtggcgaaggcatccggattgttgccccagccctggcacagcatgtaggcgatcagcgcgttgccgatgatgcgtttggaaaacgggtggccgtaggcggtttcttcccactgggcgctgaggttccagtcgtcggtgatgtcgtggtcgtcgaagatcatcaggctcggcaggtgggcgaacacccgcgccacgccgcccaggcccttggcaaaagcctcgatccgcagttgttcgcgctggtagcgctgctgctccttggcagcgagctgtggtggtcgcggatcgatcagactccaaggcaccggcgaccagaccagcaggtacatggccatgacctcggcgaaggtcaccaggtgattatcggcgctgctgctggtgaagatcggctttttcaccccgccgaagaaacgctcgcgcagggtctcgttgcttttcagcgccggcagcaattcggcgcgtttgtaatagctggcgcgatgctggtaaagcgcggcgctgtcgctcaccaccgcgccctccagatgttcgccgaacaagcccaggcgctcgatcagcgcatgaatcgcccgcagcatcggcccggccacgtcgtcggcgtacacctggtcgccggtcatcagcagcagggcagggcgttgctgcggatcggctgtttccgccagcaggcgatcgacgcaaagcaaaccttcgtccgccgaatgatggggcttgcggcaggagccgtggaccaactgctggatgcggctgtgcaggacgaaatccggctgctgtttttgcccatacagcaaatgcggcgcccactcggcgatccccgaactggagccattggccttggcgatcagcaggtcatagtcgatgggcacatcgcaaggcaggggattgtccagcggcaggtcgatcaggtggataaacgcgtgctggcctaccgggatgacctggcactgctcggcgctgagcgggtagccgcggacttgcgcctcgctgcctgcctgcaaacgcaacgtcagctccagcgcccgcgagcccaccagccacagcaccagccgcgtgggttccaggcggcgcagcagagggccggcgaggacgcagggcaagtcgatgctggaagcggtcgatggcgacggttgagacatgcaggttcgaggctcttgcggcaaacggaggcggggatagtaccgcagctgatgtcgaagaattgtcagcgagtgctcgggttgtttaagggggcgccgcacagaggggggaagaactgtgcggtgctcgtagggggttacggggtctcgggtttattgatttcccgaaggagatcggcaacgggtaattgcaaggtgttggaatagtaggctttgtagccataggcggtgatgacggctttgcaggggatactttgtttgttggctaaaagctcattcagtttgctttgggaaagaaaagtattggattgtccattgttgggcgtttcgttaagtggtagtcgagtcgtgaagttaaatgctgatgttgaagtttgaatagcatcctctttaatcaagccggcggcatagtacatgggggtatgaccaacggataggtcttggtcatcacctaaggcacagatgaaaaacgctgcagctatcccgtctcttgcactctcaccgtagagatttagtagttttacgttcgagttgtaatgaatggtgtacagcggaagatcatcttttcgttcgatagagaggaaagtcagatcggcgattacttttccatgatctttggcgcaggatgagcaaatagccattaatagcaggagcagtatttttttcatttgctgaactcctttgtaatggactcgaaaatcaggtcgcaagcgggctttcgacctgcaatggcccctgtgaacatgccgagtgcattagcatggtttgtattcatgcttacattgaggtcaggcccgctgcttattaaccatttttccccaaagttagcgacgccatccgatctatcgggattggagggtgtggctttgatgtttatccactgctcggcgacgggagttggtactgatccgtaaatatctgatccgagccataccagtgcaccctcgcctacagggtcgagagtgaccagcattttgatggtgtagccccagttggccatgatgctggtcaggtgcccgctattccaaccacccaggctgtggccgattatatagatagggcaagacttatacggaatgatattcagcacatttttttgaatatcttttttccctctgatttcattgtaccccagccactcagaccggtacttgccttgtagctggagttgtaccgctcggtcatctagaggtctctttgcctcattgatgttggcatagggaccagaaaaataataactttccttgtcccctgcacccccgacaaaaaacacaatggccttggtgctttcgataggaatgactttgtcactcttgtcttttttatccgtaagcgtgtgctcggctttcaacttgacgggtttaccgtttgccgaggtaatggtgttggcttccatgcgtcactcttccaaaaacaacttgatgctttctgcaatatgcgagctgatttcatgggtgaaaccagcggcatccgaaaccccgtgctcaaggcgcccgtcggcccgttggatcacgtaagcatgattgggcatcggttcgcccgttacatcgtttaccagcttcaaacggtcggtgaagttcaccggcatgggtaggagcccggagaagggagcgttgaccaccgtgtcgccaatgatgacggtgccggaacccccgacgatgatgttgccgtgcccgccggtgctgtccagcgtggcggcattcaagccattgatgaatacagtgctggaaaccgccccggttatcgggctgccgcacgctgattggtcactctttcgagcggcggccagaccgtcgaaaatgacattgggcgaacccgtgacgatagggttggtgccatggcccggaagcgggcaggcggttgggtcgctgacgcgggcagcgggtttgccactcatgatcggtccttgaagtgttgcgagtcatccatttggggcgcgcatgatgcagtagccgagcaggttcttcaaatctgaacttccacagatgactcggtttctgttgatgcacaggcataagcatttttctaccgaggtgcaaaaagccctccgccggaaaccgagggagggctgcatgcaagacatggtgaaactacctgtttttaattatcgccggtcggggtctcaaggacccagtggggttcaccctcgggagtcgggggtatcctgttgccgatgccgattgaccgggttttgcttgggctacctgcggggtaccaggtgccgccttgtggacatttttcgccaatctcggcggttgcgcctgcttctagtgtcatgttcatttctctttgagtgtcaccgggattagtgaccttcgaaccatgacaccgggacttttaaaaaaaaaccaagtcagagttatcattctttttatgggaattatctgtttgtcacggccgatgatgctccactcaacgttcagacgcggctctccaatcagacttttcatccgtcgtttccaaggcgggtgcttgcctcggttttaagccgaagctctttgcgactctctactctgtaccaacacctgcggctccccctgcttgatcatccagcggatcaactcggtgacgctgatgcggtgctggcgttcgacccattccaggccttcggggctgtagtgctcgctgtagcggctgagggtcaggtgctgctggtcgtctgacaggcgcaggctgacttcgcggcattgcagggaggcgtcgccgtgtttggccacgcgttgcagcaggaccagggcgtcggtttcagaagtcatcatgagtcgctccttcacagcggtttttcgcggggctggtggcgccttgcttgccttcctgcacgaaggcggcgcggtgttcggcgttcacgtcgcgcagggcgctgtagtagtccggcatggttttcaggctgtcggtcagcggtagcagggcggcgcgaccgtccactacgccaccgaccatggcgacggtgcccagggtctgcacggtgtcgctgttgtcgccgaagggggagaccacgaagttgaggatcttgcccacggagtcgcggctgttgtcggtacccagcagcggcagttcgacgatgggaccgttgccgatgccccacacgccgaaggtctggccgaagtcggcggtgtggcgtgggatgccgagcgggtccgagacgttgaatagaccgagcacgccgaccgtggtgttgaccgcaaagcgccccaggctgttgaccgagcgctgcgggttgccctgcagcaggtcgttgatgaagaccttgggctcgccgaagttgctcgcgaagttgtgcacaccttgttgcatgaagtccggcaggtggcggtaaccgcgggcgaccggtgccagtgcgtagtcgtcgacggccttgttgaaggcgaacacgccacggttgaccggctcggcggggtcatagatcggatagtcgaccttcgcgcaggcgatttgggtagtggggcccgggctggtacagcccgccaggtaggacagggacagcagcagggcggtatgacgaggcaggcgggcggaacacaggaatgagcgcatgggcggcggaccttgggaacagggaggccgatgctggcatgggcgttttgcttaaagatgtctgctttattgcggggttgtcggtttgttaccgcgttgaaatatatgacgggccgcgtccaatggttttgaatgacagctcattccgagcttgagtgatacacactggtgagcagtctgttgatcgtggacgacgaccttgaggtcctcgcgctgctgaagaaattttttgtgcaacacggctactcggtggaagtcgccaccgagggcgcttcgctgtgggcggcgctggagcggcaggtgccggacctgatcattctcgacctgatgctgccgggggaaaacggcctgaccctgtgccagcgcctgcgccagcagcacgccgtgccggtgatcatgctgaccgccatgggcgaattgagcgaccgcgtggtggggttggaaatgggcgccgacgattacctgagcaagcccttcgatgcccgcgagttgctggcccgggtgcgcgcggtgctgcgtcgggccggggagtgtcggccggtgactggggaggtgccgcgcccgttgatccggttcgccgactggcaactggacctgacccgccgcgaactgcgctcgccggaccaggtgatgatcccgctgtcggcgggggagttcgacctgctgctggtgttcgtcgagcatccgcaacgcatcctcacccgcgagcagttgctcgacctggcgcgcgggcaggcccatgacgccttcgaccgcagcatcgatgtgcaggtcagtcgcctgcggcgcaagctggagttcgacaccaagcgcccggcgatgattcgcacggtgcgcaatggcggttatctgttcacccccagcgtgacccgccaatgagagcaagacacagaccaggcggcccgcgcgacaccattgcccgctggatcgccctgaccaccctgatggcgatgctcaccgcgctggccttcaatgcgctgttcgtgcagttggccggggtctgggccaagccaccgttgagcgaatccggcctggtggagcggatcgcgtctattaccaacatgatcgaggccgccgaaccgacgcagcgctcgcgcctggccgaagtggccagcaatccggtcttgagcgtgacctggcacaacaggcgacaagacatctcggtgccggtgaccgacgacccggaataccgcacggattcggaggggcttcggcagttgctcaaatcgccgaacgggcatatcgaggcttaccagcccagcgattggcccgggccgaacggccagtacgcgttgctgatccaattggccgacgattcctggctgatgttttcttcggcgtcgcgcagttgggggttggacgaggggccgcgtaacctgatcgtgatcgggctggtgttgttgtccaccgtcctggtcgccttgatcgccacccgccgcctggccaggcccctgcagcagttcgccctgggcgcgcggcgttttggcgtggactttcgcgcgccgcccatcgagccggtcgggccccacgagattcgccaggcgatcctcgcgttcaacgccatgcaggcccagttgcagcacttcatcaaggaccgcacgcagatgcttgcggcgatctcccatgacctgcgtacccccctgacgcgcatgcgcctgcgcggcgagttcatcgaggaccccgagcagcagcgccggctgttccatgacgtcgacgagatgcaggcgatgatcaactcggccctggacttcttccgtgacgatgcgcggctggaagaggcgacgtccttcgatctggcggaactgctgcaaaccctggtcgacgattaccgcgaccagtccatcgacatcgcgttcagcggcccgtcgcgcctggtgtatttcggccgcccgctggggctcaagcgggtcatgagcaacctgctggaaaacgccatcaaatatggcagcgaaccggcgattgaagtgctggcggatgctgagcaggtgaaagtctgcgtgctggatcgcgggccggggattcctgtcgagtggcaggagcaggtgttcgagccgttcttccgtatggaaagctcgcgcaaccgcaacaccggcggcgtcggcctggggctttccgcggcgcgggcaatcgtgctggagcacggtggcgaactgcgcttgcgcaaccgtgacggtggcgggctgcaggcctgtgtgctgttgccggtgcagggtatctagctggctggccccgcttcaggatctttcagcgatcctggagcggggccttcttcaaggctggctgcttaggcgagtgtcgcctgcggattgcgcaccggctccgcagccgcttggttgtacacccgctcgtcttcctccatgacccgcgacgctcggccgaccagcactgggtcgggttgatgggccacgcgcaggtttttgcccggatagtcgagggagtgcagaaagtggcggatgcagttgatccgcgcgcgcttcttgtcgtccgacttgatcaccgtccagggcgcatcggcggtgtcggtgtggaagaacatcgcctgtttggcggcggtgtattcgtcccacttgtccagcgacttgatgtcgatgggcgagagcttccagtgcttgagcgggtcgtcgcggcgcgaaatgaagcggcgcagttgctcatcgcgattgaccgagaaccagtacttgaacagcaggatgccgctgttgcacagcatgcgttccagttcgggcgtctggcgcatgaactccaggtattgcaggggcgagcagaaatccatgacccgctcgaccccggcgcggttgtaccaggagcggtcgaagaacaccatttccccggcggtgggcaggtgctggatgtagcgttggaaataccactggccctgttcctgctcgctgggcttttccagggcgacgatccgcgcgcctcgcgggttcaggtgctccatgaagcgcttgatggtgccgcccttgcccgcggcatcgcgtccctcgaacagcaccacgacgcgctgcccggtttccttgacccagctttgcaccttgagcagttcgatctgcaactcctgcttggccttttcatactcggcgcggcgcatgcggctgcggtacgggtaactggccggcagcttggcggtggaactgtcctcattgcgtggggcgcgctggccacctgcagggcgaccggctgctggctgatggcgctgatttccgcctcggcggttttggccgctgcaggcttactggccgcacgaggccggcgcgggcgtggggtggtgggcttgcgtggggcgcttttgctgttggccgtgacggtgggtttggcggtgggtgtggctttttcgggtagagggttgggaaggggacgcgcggtggattcttcgctcatatcgggcctgtctgatcgctccaatgtctttcagacagtctatggcgcacaagtcagggcttcttgatgcgtatcaaggaagcttttgagcaggtttgcattggcgctttttagtcctctgtaggagcgaggcttgcccgcgaaacagacgctgcgcagtgccggtctctccgcgtcatcgttcatcgcgagcaagcttcgctcctacggaatcctggcgcccaggggctgcggcacttttctgcaggcgaaaaaaaagaccttgaatttcaaggtcttttttaagtttggtgccccgagggagactcgaactcccacttctctcgaaaacggattttgaatccgccgcgtctaccaattccgccatcagggctcaatggcggcgaagtatagagacgtgcctaccgttggtcaatcaggtttcatggtcaattttggctatttccgctaaactttccggccctgctagacgaaccccatcatgcgtgttgctgactttaccttcgagctccctgattcgctgattgcccgccaccccttggccgagcgtcgcgcgagccgcctgttgaccctggatgggctcaccggcgccctggcccaccgtcaattcactgatttgcttgagcatttgcgcccgggcgacttgatggtgttcaacaatacccgggtgattccggcgcgcctgtttggccagaaggcctccggcggcaagctggaaatcctcgtggaacgggtgctcgacagccaccgtgtgctggcccacgtgcgctccagcaagtcgccgaaaccgggctcgaagatcctcatcgacggcggtggcgaggccgagatgctggcccgccacgacaccctgttcgagctggggttcgccgaggaagtgttgccgctgctggagcgcgtcggccatatgccgttgcctccttatatagaccgcccggacgaagactcggaccgcgagcgttatcagaccgtgtattccgagcgcctgggcgcggtggccgcgccgaccgcggggctgcacttcgaccagccgctgctggaggcgattgccgccaagggcgtcgagaccgcgttcgtgaccctgcatgtcggcgccgggactttccagccggtgcgggtggagcgcatcgaagatcaccatatgcacaacgaatggctggaagtcagccaggacgtggtggatgcggtggctgcctgccgcgcgcgcggcggtcgggtggtggcggtggggaccaccagcgtacgctccctggaaagcgcggcgcgcgatggcgtgctcaagccgttcagcggcgacaccgacatctttatctacccgggccgaccgttccatgtggtcgatgccctggtcaccaacttccatttgcccgaatccacgctgttgatgctggtttcggcgttcgccggttatcccgaagccatggccgcctacaaggctgccgtcgagcatggataccgctttttcagctacggtgatgcgatgttcatcacccgcaatcccgcgccacgcggccctgaggatcaagcatgagtcgcacctgtcgtatgtctttcgagctgctcgccaccgatggcaaggctcgtcgcggtcgtctgaccttcccccgcggcactgtggaaaccccggccttcatgcccgtgggcacctacgggacggtcaagggcatgctgccgcgggacatcgtcgccactggcgccgagatcatcctgggcaacaccttccacctgtggctgcgcccgggcaccgaagtgatcaagaagcacggcgacctgcatgatttcatgcagtggaaaggcccgatcctcaccgactccggcggtttccaggtgttcagcctgggcgccatgcgcaagatcaaggaggagggcgtgaccttcgcctcgccggtcgacggcgccaaagtcttcatgggcccggaagagtcgatgcaggtccagcgcgacctgggctcggacatcgtgatgatcttcgacgaatgcaccccgtacccggccgacgaagacgtcgcacgggtgtccatggagctgtcgctgcgctgggcccagcgctcgaagaacgcccatggcgacaatacggcggcgctgttcggcatcgtccagggcggcatgcaccaggacctgcgcatgcgttccctggaaggcctggacaagatcggcttcgacggcctggccattggtggcctgtcggtgggcgagcccaagcacgagatgatcaaggtgctggactacctgccaggccagatgccagcagacaaacctcgttaccttatgggtgttggcaagccggaagatctggttgagggtgtgcgccgcggtgtggacatgttcgattgcgtgatgccaacccgtaatgcccgcaatgggcacttgttcattgacactggcgtgctgaagatccgcaacgcgttccatcgtcatgatgattcgccgctggatccgacctgcgattgctatacctgccagaacttctcccgtgcttatctgcatcatctggacaagtgcggcgaaatgctggggagcatgctcaataccatccataatttgcgtcattaccaacggcttatggctggtttgcgcgaggctattcaacagggtacattggccgcctttgtcgattccttctatgccaaacgcgggttacccgtgccgcctttagaataagttctaaagacgtttagacccacttttgcaattatccggagtgttacatgagcttttttatctcgactgcaatggctgatgctgctgcacctgctgctggccccgccggcactggctttgagtggattttcctggtcggtttcctggtcatcttctacctgatgatctggcgtccacaggccaagcgcgccaaagagcaaaagaacctgctgggcagcctgcaaaaaggtgacgaagttgtgactactggcggtatcgccggcaagatcaccaaagtgaccgatgacttcgtagtgctggaagtttccgacactatcgagatgaagtttcagaaaggcgcgatcgctgccacgctgccaaaaggcacgctgaaggcgatctaagtttcaacttttaccaatcgacggggcgcgcaaggcgccccgcttcataaacgggcggcgtgatgctgaacaaataccctctgtggaaatacgtactgatcctggcggtgctggcgatcggttttatttattccgctcccaatctataccctgatgatccggccattcaggtcagcggcgcgagcaccgcgttgcaggtcactcaggcggatctggatcgtgcgagcaaagcgctcaccgacgccgggatcaacgtcaaggcagcgaccatcgcggccaagggcaagggcggcctgttgcgtctgaccaagcaggaagaccagcttccagccaaggacgttgtgcgcaaggccctgggtgacgactacgtcgttgcattgaacctggcacaaaccaccccgcaatggctgcgcaacctcggcgcgcatccgatgaagctgggcctggacttgtccggtggtgtgcacttcctgctggaagtggacatggaaaaagccctcgatgcacgcctgaaagtctacgaaggcgatgtgaagagcctgctgcgtaaagagcgtctgcgctatcgcagcctgccgcagctgggcggtgccattcaactgggcttcagcgacgaagcgacccgtgaacaggcccgtgcgctgatccgcaagaacttcaacgatttcgacattgttccggccgacctcaatggtcaggcggtgctgcgtctggcgatgaccccggccaagctggcggaaatccgtgaatactccatcaagcagaacttgaccacggtgcgtaaccgcgtcaacgagctgggtgttgccgagcctctggttcagcgccagggtgccaaccgtatcgtggttgagctgccgggcgtgcaggacaccgctgaagccaagcgtatcctgggcaagacggccaaccttgagttccgtctggccgccgagccgggcgcttcgaaagccacttccgagtctttcgagttccgtgaaggcaatcgtcctcctgcgctgatcgagcgtggcctgatcatcactggtgaccaggtgaccgacgcccaggcgggcttcgacgagcatggtcgtccacaggtgaacatcaagctcgatggccacggcggcgagctgatgagtcgttcgacccgcagcaacgtcggtcgcagcatggcggtgatcttcatcgagcaaaagccgaccaccacttacaccaagcaagtggtcgacggtgtcgagaaagacgtcgcggtgcagagcttcaaggaagagaagaagatcatcagcctggcgaccattcagtcgccgctgggtagccagttccgcatcactggcctgaacggccagggcgagtcctccgagctggcgctgctgctgcgtgccggtggtctggccgcaccgatgtacttcgccgaagagcgcaccatcggcccgagcctgggggccgacaacatcaccaagggtatcgatgcatcgctgtggggcatgctgttcgtgtcgctgttcatcatcgccatctaccgtttcttcggcatcatcgccaccgtggcgctggcgctgaacatggtgttgctgctggccctgatgtccttgctgggggctacgctgaccctgccgggtatcgccggtatcgtgctgaccatgggtatggcggtggacgccaacgtactgatcttctcgcggatacgtgaagagatcgccgccggcatgaccgtgcagcgggcaatcaacgaaggcttcggccgggcattcaccgcgattctcgactccaacctgaccacgttgctggtcggcgggattctctttgccatgggcaccggcccggtcaaaggctttgcggtgaccatgtccctcgggatctttacctcgatgttcacggccatctggctgacccgcgcgatggtcaacctgatcttcggcggtcgtgacttcaagaagttgtggatttaaggggctgccatgttacgtactatcaacttcatgggcgtgcggaacgttgcgttcggcgtcactttgctcctgaccgttctggcgctgttcagctggttccacaaggggttgaactatggcctggactttaccggcggtacgctcatcgagctgacctacgagcgtccggcggatgtgatgaaggttcgtgctcaactgagcgagtccggctatcacgaagcgatcgtgcaaagcttcggtgcgaccaccgacctgctggtgcggatgccgggtgaagatccgcaactgggtcatcaggtggcggaggcgctgcagaagaccggcggcgacaacccggcgcaggtcaagcgcgtcgagttcgtcggcccgcaagtgggtgaagagctgcgcgaccagggcggcctcggcatgctgatggcgctgggcggcatcctgatctacctggccttccgctttcagtggaagttcgcggtcggcgccatcgtctcgctgatccacgacgtggtggtgaccgtgggtatcctgtcgttcttccagatcaccttcgacctgacggtgctggcggcggtactggcgatcatcggctactcgctcaacgacaccatcgtggtgttcgaccgggtgcgtgagaacttccgtgtgctgcgcaaggccagcctgatcgagaacatcaacatctcgaccactcagaccctgttgcgcaccatggcgacctcgatctccaccctgctggcgatcgcggcactgctgttcttcggtggcgacaacctgtggggcttctccatcgccttgttcgtcggtgtcctggcgggtacctactcgtcgatctacatcgccaacgtggtgctgatctggctgaacctgagcagtgaggacctgattcctccggccaataccgagaaggaagtcgacgaccgtccataacggtttccgcttcccggcaagcagtcgaaaaggcgcgagtattgaactcgcgcctttttttatgctccaaggctgggagaagcgcgggctcgtcccgcttgtgatggtcaggaggttcacgtgaacaagtcgatgctggttggtgcggtattaggtgccgtcgctgtgactgctgggggggctgttgccacctacaagctggtcaatagcggccctgagtatgcgcaggtgctggcagttcagccggtcaaacaacagatcaaaacaccgcgtgaagtgtgcaaggacgtcaccgtgacccgtcaggctccggtgaaggatcaacatcagatcgccggtacggtggtcggtgcgctggccggtggccttctgggcaaccagatcggcggcggtacgggcaagaagatcgccacggtcgccggtgcggtcggcggtggttacgccggtaacaaggtgcaggaaggcatgcaggagcgtgatacctacaccaccactcagactcgctgcaacacggtcaatgacatcagtgaaaaggtcgtgggttatgacgtgaagtacgaactgaacggcaagcagggtcaggtgcgtatggatcgtgatccaggcagccagattccggtcaacaaggaaggtcagttgatcctgggccagaaccagccggtgcaataagcattcagtgtcatcatgaaaaagcaccctgcggggtgcttttttattgcctgcaggtttttgaggcttctacagggagagttgttttccgataaaccccaggcataaaaaaagcaccccgaggggtgcttttttgtcgctggcgcttagcgcttcagcgaagccggcaggtgcggctggatggcggtgaggaccgccttgaagcatttggtgttgccggcaaccacgtggcctttttccaggaagtcgtgaccgccggtgaagtcgctcaccagtccgccggcctcttggatcagcagggcgcctgcagccatgtcccactcggacaggcccgactcccagaaggcgtcgaaacgaccggcagccacgtaggccaggtccaggctggcagcgccggcgcggcggatgccggcggtctggccgaccagggcgcggaacatgcccaggtagttgtcgaggttgtccatctggtcgtcacggaacgggaagccggtacccagcagggcgccgtccaagctggtgcggccgctgacgcgcaggcgacgaccgttcagttgggcgccgcgaccacggctggcggtgaattcttcctggcgcaccgggtccagaaccacggcgtgttccaggcggccgcggtatttgcaggcgatgctgacagcgaaatgaggaatgccgcgcaggaagttggtggtgccgtccagtgggtcgatgatccacaggtagtcttcgccttcgccgctgccagcgtgcaggccggtttcttcaccgagaatgccgtgagtcgggtaggccttgcgcaatgcgtcgatgatcttctgctcggcagcgcgatcaacttcggatacgtagtctttggcgtctttttcgtcgaccttgatggtatccaggcgctcgatggagcggaaaatcagttcactggcgctgcgggcggcgcgcagcgcgatattcagcattggctgcatggataggtcacctaaggttgttaaagaaagccgagcattctagcagaaaacttttgcagatgaaggtcgacattcgctccgcttgccttgacctgccgctcaagcccataaatacgcggacattttgacgagtggtggttcgtctggagctggtcggcttctataaggtgcgatccggaagcagttatttttgaggcgggagcgctggctgttctgtaagatttgctcccctttcccgtgtccgagagcgcctcccttgctgcagaacattcgtgtcgtcctggtcaataccagtcatcccggaaacatcggcggggctgcgcgtgccatgaagaacatggggctgtcgcggctggtgctggtcgagccgcggattttcccttcccatgaggccgatgcgcgggcctccggcgctaccgacattctggaaaacgctcaggtggtcgccaccttggaggatgccctggccggctgcaccctggtgtttggtaccagcgcccgtgaccggcgtattccctggccgttgctcgacccccgtgagtccggggtcaaggtggtgcaagaggcagggcagggcgccgaaattgccttggtcttcggtcgtgaggattccggcctgaccaatgacgagctgcagcgatgtcattttcacgtgcatatcccttcggacccggagttcagctcgctgaacctggcgacggcggtgcaggtgttggcttatgaagtgcgtatgtcctggctggcggccgaaggccagccgagcaaggtcgagaaggatgaagtggcgtcgccgcgcagtgatgagctggcgaccatggacgaactggagcggttctacgagcatctggagcagacgctggtggccattgacttcctcgatccggaaaaaccacggcacttgatggcgcgcctgcgccggttgtacggacgcagctcggtgagccgggcggaaatgaatattttgcgtggcatcctcacggagacccagaaagcggcccgtggcgagctccttaagcggaagaatgatgatgtttgagcgtttgcgtgaagatatccagagtgttttccatcgtgacccggcggcgcgtaatgcattcgaggtcctgacctgctacccgggcatgcatgccatctggattcatcgcctgtccggcgcgttgtggggcatgggttggaagtggctggcgcgcctggtgtcgaacttcgggcgctggttgaccgggatcgagattcacccgggggccaaggtcggtcgccgtttctttatcgaccacggcatgggcatcgtcattggcgagaccgccgagatcggtgacgacgtgaccctctatcagggcgtgaccctcggcggcaccagctggaacaagggcaagcgtcatccgaccctggaagatggcgtggtggtgggggctggcgccaaggtgctggggccgttcactgtaggggcgggcgccaaggtcggctccaatgcggtggtgaccaaggcggtgccggcgggcgccacggtggtgggtattcccgggcgtatcatcgtcaagtccgatgacgagcaggaagccaagcgcaaggccatggccgagaagctcggtttcgacgcctatggggtcagcgaggacatgccggacccggtggcgcgggccattggccagttgctcgatcacctgcaggccgtcgatgggcgtctggagggtatgtgcggggccttgaaggatcttggcagtaactactgtgccaaggatctgccggcgctgcgcgatgaggacttcgcgggcgtcaaggacaagggcgacagccaggtcggctgagcctttcgggtgctttggcgttgatcgcgagcgggctcgctttgtcgaaatgagcctgctcgtgcagcgcccaaaagggcgttagcgacccattagtcaccgagcaaatccagggcgtgccattaccctgcagactttgctatgattcgcgcgctcttttgcgggtaaacctgactaaagtagtaggtcttatagttgacttaattactcgggaattgcatactcgctcccatcccgaaacactccgtggtacttgtccatgcgactgactacaaaaggccgatacgcggtaacagccatgcttgacctggcgttgcacgcgcaacatgggccggtgtccctggccgatatctctgagcgccaaggcatctccctgtcctatctcgaacagctcttcgccaagctgcgccgcagcaatctggtgtccagcgtgcgtggtccaggcggtggctaccagctgtcgcgtgacatgcaaggcattcaggtggcccaggtgatcgatgcggtgaacgagtcggtcgatgcaaccaaatgccagggccagggcgattgccattccggcgacacctgtctgacccaccacctgtggtgcgatctgagcctgcagattcacgaatttctgagcggtatcagcttggctgaccttgtgactcgccgtgaggtgcaagaagtagcccagcgtcaggatcagcgccgctgtaatggcaaggcgcagcacctggacaagattgaagcgtccgccgtcgaatgacagccaaagagctagcggcacgccagccagcctgatttaggagagagtccatgaaattgccgatttaccttgattactcagcgaccaccccggttgatccgcgtgtcgcgcaaaagatgagtgaatgcctgctggtcgacggaaacttcggtaacccggcgtcccgctcccacgtgttcggctggaaagccgaagagtcggtggaaaatgcccgtcgccaagtggctgacctggtcaatgccgacccgcgtgaaattgtctggacctccggtgccaccgagtccgacaacctggcaatcaagggtgtcgcgcatttctaccacaccaagggcaaacacctgatcacctcgaagatcgagcacaaggctgtcctggacaccatgcgccaactcgagcgtgaaggcttcgaagtcacctacatcgagccaggcgaagacggcctgatcactccggccatggttgaagctgccctgcgcgacgacaccatcctggtttcgatcatgcacgtgaacaacgaaatcggcaccatcaacgacatcgccgccatcggcgagctgactcgttccaaaggcattctgttccacgtcgatgcggctcagtccaccggcaaggtcgacatcgacctgcaggcgctgaaagtcgacctgatgtccttctccgcccacaagacttacggtcctaaaggtatcggcgcgctgtacgtcagccgcaagccgcgggttcgcctcgaagcgaccatgcacggcggcggtcatgagcgcggcatgcgttccggcaccctggccacccaccagatcgttggcatgggcgaagccttccgtgtagccaaggaagacatggctgccgaaaacctgcgcatcaaggcgttgagcgaccgcttctacaagcaggtcgagcacctggaggagctgtacatcaacggcagcatgacctcccgcgtgccgcacaacctgaacctgagcttcaactacgtcgaaggcgagtcgctgatcatggcgctcaaggacctggcggtttcctccggttcggcctgcacatcggcttcgctggaaccttcgtacgtgctgcgcgccctgggccgcaacgacgaactggcacacagctcgatccgcttcaccttcggccgcttcaccaccgaagaagaaatcgattatgccgcgcagaaagtctgcgaggccgtgaccaagctgcgcgctctgtcgccgctgtgggacatgtacaaagacggcgtcgatatctcgaagatcgagtgggcggcacactaaatatagaagccgccaggtacagctcctgtagcgacgcggcgactgacgcaggcgtaactacaggggctcaagagcggccctgatgagtgaggattaagaatcatggcttacagcgaaaaggtcatcgaccactacgagaacccgcgcaacgtcggcaagatgaacgcggaagatcctgatgtcggcaccggcatggtcggcgctccggcgtgcggcgacgtgatgcgcttgcagatcaaggtcaacgagcagggcatcatcgaagacgccaagttcaagacctatggttgcggttcggcgatcgcctccagctccctggctaccgagtggatgaaaggcaagactctggatgaagcagagaccatcaagaacactcagctggctgaagagctggccctgccgccagtgaaaatccactgctcggtactcgccgaagacgccatcaaggccgccgttcgcgactacaagcagaagaaaggcctgatctgattttcgcggatcagctttcacagattgagcgacaagtaaggagtcacgatggctatcagcatgacagaagcggctgctcaacacgtgcggcgctccctcaacgggcgcggcaaaggtgatgggattcgtctgggtgttcgcaccacgggctgttccggccttgcctatgtcctggagttcgtcgacgagatcggtgaagacgatcaggtgttcgagagtcatggcgagaaagtgatcattgatccgaaaagcctgacctacctggacggcaccgaactggacttcgtcaaggaagggttgaacgagggcttcaagttcaacaaccccaacgtgcgcggtgaatgtggctgcggcgaaagcttcaacatctgaggcagctcgtgggtactccttgtcatttcgctttatttgagctgcaaccgagcttccgcctggatctcgagcagctggccacgcgctaccgtgagttggcgcgtgccgttcatccggaccgcttcgctgacgcttctgagcgtgagcagcgcctggcgctggaacaatccgccagcctcaacgaggcctaccagactctcaagagtcctcccaaacgcgcgcgatacctgcttgcgatgggcggccatgagctgccgctggaggtcacggtgcacgatccggagttccttctgcagcagatgcagtggcgcgaagagctcgaggatctgcaggacgaggccgatctggccggtattgcagctttcaagcgccgcctgaaagtggcccaggatgaattgaacgaaagcttcgcagcctgttgggatgatgctgcgcaacgcgaacaggccgagcgcctgatgcggcgcatgcagttcctcgacaagctcacctacgaagtgcgccagttagaagagcgcctcgacgattaacccagtgccgctccggtcgcacgcctgatatacagataagtccagataaacatggccctactgcagatcgctgaacccggccaaagtcctcaaccgcaccagcgtcgcctggctgtggggatcgacttgggtactaccaattcgctggtcgctgccttgcgcagtggtctttccgagccgctggccgatgccaacgggcaggtcatcctgccgtctgccgtgcgctatcacgccgaccgtgtcgaggtgggcgagtccgccaggctggcggcgtctgccgatcccctgaacactgtgttgtcggtcaagcgcttgatggggcgtggtctgtccgacgtcaagcaattgggcgagcagctgccataccgcttcgtcgacggcgagtcgcacatgccgttcatcgacaccatccagggcccgaaaagcccggtggaagtctccgccgatatcctcaaggtcttgcgacagcgtgccgagtcgaccctgggtggtgaattggtgggggcagtgattaccgttccggcctatttcgacgatgcgcagcgtcaagcgaccaaggatgcggccaagctggccggtctcaatgtgttgcgtctgctcaacgagccgaccgcggcggccgtggcctatggcctggatcaacacgccgaaggtgtggtggccatttatgacctgggtggcgggactttcgatatttccattctgcgcctgaccggcggcgtcttcgaagtgctggccaccggtggcgacagcgccctgggcggtgacgatttcgatcatgcgatcgccggctggatcatcgagagcgccggcctgtccgccgatctcgatccgggcaagcagcgcaatctgctgcaaatcgcctgtgccgccaaggaagcgcttaccaatgccccgtcggtcgaggtgacctatggcgcctggtcggcaccgctgacccgcgaagccttcgatgctctgatcgaaccgatggtggcgcgcagcctcaaggcctgccgtcgcgccgtgcgtgattccaatgtcgagctggaagatgtccaggcagtggtcatggtcggtggttcgacccgtgttccacgggttcgcgaggcggtcgccgaaatgttcggtcgccagccgctgaccgagatcgacccggaccaggtggtggccattggtgccgcgatccaggccgataccctggccggcaacaagcgcgatggtggcgaactgctgctgctggatgtgattccgctgtccctggggctggaaaccatgggtgggttgatggagaaggtgattccgcgtaacaccaccatccccgttgctcgggcccaggacttcactacttacaaagatggccagtcggccatgatgattcatgtgttgcagggcgagcgcgagctgatcagcgactgccgttccctggcgcgtttcgaactgcgcggcattccggccatggtcgccggggcggcgaagatccgcgtgaccttccaggtcgatgccgacggtctgctgagcgtgtccgctcgtgagctgggctcgggcgtcgaagccagcatccaggtcaagccctcctatggtctgaccgatggcgaaatcgccaggatgctcaaggattccttccagtacgccagcgacgacaaggtcgcccgcgtgctgcgtgagcagcaggtcgatgcccagcgcctgatcgaggcggtgcagggcgctctggaagcggacggcgagcgtctgctggatgccgaagagcgcatggtcatcgagctgcaaatgcaggaattgagtgaattgatgcgtggcaccgatggttacgccatcgagcagcagaccaagcgtctgtcgcaagtgaccgatgcttttgctgcccgccgcctggactcgacggtgaaagccgctctggcggggcgcaatctgaatgaaatcgaggaataactaatgccgcagatcatttttctgccacacgccgtgttttgcccggatggcctggttgtagaggctgccccgggtacctcgattctcgaagtggcgcatgacaaccacatcgagatcgagagcgcttgcggcggcgtctgcgcctgtactacctgtcactgcatcgttcgcgagggtttcgactcgctgaacgaagccgacgagctggaagaagacttgctggacaaagcctggggcctggaggcgcaatcgcgtctatcctgccaggcgatcgtcggcgaggaagacctgaccgtcgagattccgaaatactcgctcaaccatgcagccgaagcgccgcactgattcaaggaatcatcatgagtctgaaatgggttgatgtgctggaaatcgcgattcagctggctgaatccaagccggatgtggatccgcggtacgtaaactttgtcgatctgcaccaatgggttctggcactgccggaattcagcgacgatccggctcgcggtggcgagaaggttcttgaagccattcaggccgcctggatcgaagaagcagactgagtctgtcccgtacgcagttaggcaatccctataaacccgcgtataattcgcgggtttaatttttcgctttaatcaccgtttctggagttacaccatggctgttcaacgtactttctccatcatcaagcctgacgctgttgcaaaaaacgtcatcggcgagatcgttacccgtttcgaaaaagctggcctgcgcgttgtagcttcgaaaatgaagcaactgtcgaaagccgaagctgaaggcttctacgctgagcacagcgctcgtggcttcttcggcgagctggttgctttcatgacttccggtccggttgtcgttcaggttctggaaggcgaaaacgctatcgctctgaaccgtgagctgatgggcgctaccaaccctaaagaagctgctgccggcaccatccgcgctgacttcgctgagtccatcgacgccaacgccgttcacggttcggactccgaagccgctgctgcacgcgaaatcgcttacttcttcgcttccaccgaagtgaccactcgctaagccaaaggcccgtgagtgaaggtgaaaccatgactacatcgactggcaaaactaacctgttgggtctgactcaaccggaaatggaaaaattcttcgacttaatcggggagaagcgtttccgtgccggtcaggtaatgaaatggattcaccactttggcgtcgatgatttcgacgccatgacgaacgtcggcaaggccttgcgcgaaaagctcaaggccgttgccgaaattcgtggtccggaagtggtcagtgaggacatctccagcgacggcacccgcaagtgggtggtgcgcgtggcgtccggcagctgcgtcgagaccgtttacattccccagggcaaacgcggcaccttgtgcgtttcgtcccaggcaggctgtgccctggactgcagtttctgctccaccggcaagcaaggcttcaatagcaacctcaccgccgccgaagtcatcggccaggtgtggattgccaacaaatcctttggcagcgtcccggcgaccgtcgaccgtgccatcaccaacgtggtgatgatgggcatgggtgagccgctgctgaacttcgacaacgtcatctcggccatgcacctgatgatggacgacctgggctacggcatttccaaacgccgcgtgaccctgtcgacctccggcgtggtaccgatgatcgatgagctggccaagcacatcgacgtttccctggcgttgtccctacacgcaccgaacgatgcgctgcgcaaccagctggtaccgatcaacaagaagtacccgctgaagatgctgctcgagtcctgccagcgctacatgtcgtcgctgggcgagaaacgtgtgctgacgattgagtacacgctgctcaaggacgtcaatgataaggttgaacacgctgtcgagatgatcgcgttgctcaaggacattccttgcaagatcaacctgatcccgttcaacccgttcccgcattccggttatgagcggccgagcaacaacgccattcgccggttccaggatcaactgcatcacgcaggcttcaacgtcaccgtgcgcaccacgcgcggcgaagacatcgatgcggcctgtggacaactggtcgggcaggtgctggatcgcacccgtcgtagcgaacgttatatcgccgtgcgcgagttgagcgccgacgccgatatgccgcaaagcgctgcgaatcgtacctgagagaggatctccatgaccttgcgcgtcgcgctgcttctgctttttgtcagcctgtcggctggctgtgttctttcgggggatttcaacccgatgaagacaagcaaggggcgggacgaggcgcgtgaggcctatgttcagctgggcctgggttatctgcagcaaggcatgaccgagcgggcgaaagtaccgttgaaaaaggccctggagctggatgagtccgatgctgacgccaatgccgccctggctttggtgttccaggctgaaatggaacccgagctggctgaccagcattaccgcaaggccctggctgctcgtccctccgatgcccgtatcctgaacaactacggcagttttctctttgaagaaaaacgttacaaagatgcttatcagcgctttgaacaggcggctgctgataccctgtaccccgagcgatcccgagtgttcgagaaccttggcatgaccgccgcgatgctgggtgagcgtgacctggcccggcaacacctggaaaaagccctgcgcctgaaccgccagcagcctcgcgcattgctggaaatggctgagttgtccttcgaagacaggcattatgtgcccgcacgcgactattacgatcgttttagcctgctgagcgagcaaaatgcacgtagtctattgctcggcgttcggctggcaacggtgttcgaagatcgcgacaaggccgccagttacggcctgcaattaaaacgactctatcccggtacgccggaatatcagcaatacctgtcggagcaatgatgaaagcggcgcatcccgaagttctagcagcgactcgcgtcaaccccggtgagaccctgcgtcaggcccgcgaaagcaatggttggtcgctggctgaagtggccctcaagctcaatctgaccgcaaactcgttgagcaacctggaagccggcgctttcgacaaactgccggggcataccttcgcccgcggttatatccgtgcctatgccaagttgctggggatggaccaggccgttctggtccaggccttcgaccaatacacgggcaccgattcccagggcagcaatgtgcacagcctcggccgtatcgaagagccagtacgggtttcccacaccattttgcgcatcgtcagcctgttgctgctgatcgcggtgatcggtggtggctttatctggtggcaggatcaaacgtccgtacgcaccaaggagctggttggcctcaatcaggaacacgtcgaagtcgaaggggccgacggtaccacgcagattcatccgatcgacgagccggaagaccaggcggtcgtggaaggtcagaccgagggcgaaaccgccctggtcctacctgaaaccccggctccaggccaggccgctgcggatgccgcggctcctgcgccaagtgctccggctgccgcacctgcagccccggttgctcctgctccagtggtcgtggcaccagcgccgagcgctccggccgcgcctgccccagtagcgcccgtggtcgcagcagcgactattccggctgccccggcagctccaactgcgcccgccgccgcacctgtagccggcgcgggtcaggtacagatccagttcacagccgattgctggacccagatcaccgacggcagcggaaaagtgctgttgagtggcctgaagcgcaagggtgagaccgccgatgtttccggcaagccgccatttgccgtgcgcctgggttatgcccgtggtgcgcaggtcagctacaacggacaagcggtcgatgtggctccgttcaccagtggcgagactgctcgcctgaagttaggtcaatagtcatgcacggcgaatctccaatcaaacgtcgcgagtcccgcaagatctgggtcggctcggtacccgtgggtggcgatgcccccattgccgtgcagagcatgaccaacagcgacaccaacgatgtggcagccactgtggcccagatcaaccgtctggaagccgccggtgtcgatatcgtgcgggtttccgtaccggatatggacgcggccgaagctttcggccgtatcaagcagcaggtcaaggtgccgctggttgccgacatccacttcgactacaagatcgccttgcgcgtggccgaactgggcgtcgattgcctgcggatcaaccccggcaacatcggtcgtgaagaccgcgtgcgtgcggtggtggacgcggcccgtgatcgcgggatcccgatccgtatcggtgtcaacgccggttccctggaaaaagacctgcagaagaaatatggcgagcccaccccggctgcattggtggagtctgccctgcgtcacgtcgagcacctcgagcgtctgaacttcaaggacttcaaggtcagtgtgaaagcctccgacgtgttcatggccgtcgaagcctatcgcctgctggccaaggaaatcatccagccgctgcacctgggtatcaccgaagccggcggtttgcgttcaggcacggtgaaatccgccgtgggcctcggtatgctgctggccgaagggattggcgatactattcgcatctcgttggcggccgacccggtcgaagaagtgaaagtcggctacgacattctcaagtccctgcatctgcgttcccgtggcatcaacttcatcgcctgcccgagctgctcgcggcagaatttcgatgtggtcaagaccatgaacgaactggaagggcgtctcgaggatctgctggtaccgctggacgtggcggtcatcggttgtgtggtcaacggtccgggtgaagccaaagaggcgcacatcggcctgaccggcgggacgccgaacctgatttacatcgacggcaagccgtcgcagaaactgacgaatgacaatcttgtggatcaactggaaaaactgatccgcgagaaagcggccgaaaaggtcgaagccgacgcagcgctgatcgcgcgcggctaatcgaacgaattaaggattttttgtgagcaagtctctgcaagccattcgtggcatgaacgacatcctgcccgagcagacgcccctgtggcgctatttcgagggcaccgttgcgcggttgctggataactacggttacaagcagatccgtatgccgatcgtcgagttcaccgagctgttcaagcgctccatcggtgaagtgaccgacatcgtcgaaaaagagatgtacaccttcgacgaccgtaacggcgactccctgaccctgcgtccggaaggcaccgcggcgtgcgtgcgcgctgtgctcgagcatggcatcactggcggtggccaggtgcagaaactctggtacatcggcccgatgttccgtcacgagcgtccgcagaaaggtcgttatcgccagttccaccagatcggttgcgaagtcttcaacctcgacggtccggacatcgacgccgaactgatcgtgctgacctggcgcctgtggggcgaactgggtatccgtgatgcggtcaagcttgaactgaacagcctgggaaccgccgaagcccgtgcgcgttatcgcgatgcgctggtgacgttcctctcggcacgcatggacaagctcgacgaagacagccagcgccgcctgaaaaccaacccgctgcgtgtgctcgacaccaagaatccggacactcaagccgtactggtggacgcgcccaagctggccgattacctggacgaagagtcccgcgtgcacttcgaggggctcaaggcccgtctggatgccgccggtatcccttatgtgatcaacccgaagctggtgcgcgggctggattactacagcaagaccgttttcgaatgggtcaccgacaagctcggcgcccagggcaccgtctgtgccggcggccgctacgacggcctggtcgagcagatgggcggcaagcctaccccgggcgtcggtttcgccatgggtatcgagcgtctggtactgctgctggaaaccctggagcagatcccggaagagatctcgcgccaggtcgacgtttacctctgcgccttcggggaagccgccgaactggctgctctggcgctgagcgaacgggttcgtgatcaattgcccaacctgcgcctgcagatcaacgccggcgccggcagcttcaagagccagttcaaaaaggccgacaagagcggtgcgttgtacgcattgatcctcggtgacgacgaactggcccagcaagtggtaggtttcaaacccctgcgtggccagggcgaacaacaaagcattgcctgggatgcgctcgctgcacacctggccacctgcgtcgtgcagggttgaagctgtcaaacagccgatttagcgaataaggagtattggggtgtcgagtaccgaagatgaacagctggcggatttgaaggactggtggcagcgcaacggcaagcccttggtcaccggcggcctgttggcgctggtcatcgtgttcggctggcaggcctggcacaagtatcagaacaatcaatcgcaaggcgcctcgatgctctatcagcaattgctggagaccacgctgacgcctgacggcaagccggatgcagcacgtgtggcagacctggccggcaagctcaacagtgagttcggcggtactgcctacgcgcaatacggcagcctgttcgtcgccaaggtggcggtcgacaccggcaagctggacgacgcagcgaccgagctcaaagccatcgccgacaagccggccaacccgacgctgggcgaaatcgcccgtcagcgcctggcccaggtcctggccgcgcagaacaaggccgatgaagcgctgaagctgctcgaaggcgatgccgacaaggcgttcctggccactcgcgaagagctcaagggcgacctgctggtccaattgggccgtaccgacgaagcccatgctgcgtatgaaaaagccaaggccgcgctgtccgatgaagcggcggtcggtggcctacaaatcaagctggacgacctggccaaaggggatgcgtgacgtgatccgttggaaacatgcagcattgctggctctggccgttctggccgcgggttgcagcagcaacagcaagaaagaattgccacctgccgaactggtcgacttcaaagaagaagtggtcctgcagaaacagtggagccgttcggtcggtgacggccagggcgaaacctacaacatgctggttccggcgatcgacggcagcaccatctacgccgccgacgtcactggcgtggtagaggcactggatcgcatgaacggcgacgtcaaatggaaacaggacctggagttgcccgtgtccggtgccgttggcgtgggttacggtctggtcatgatcggtaccctcaagggcgaagtggtcgctctggatgcttcgagcggcgaagagaagtggcgcgcgcgggtgaccagtgaagtactggctccgccgtccaccaatggcgatgtggtggtggtccagacccaggatgaccgtgtgatcggccttgatgccgccaccggcaaccagatgtgggtctacgacagcaccccagcggtactgaccctgcgcggcaccagtgcgccaatcaccaccaaccgcctggcggttgccggtctgtcgaccggtaaagtggtggccctggatatccgtaacggcgtgccggtgtgggaacagcgcgtggctattccgcaaggtcgttccgagctggatcgcgtggtcgacatcgacggtggcctgctgttgtccggcggcaccctgtatgtcgccagctaccagggtcgcgtagcggcgctggacctggaaagcggtcgtccgctctggcagcgcgatgcttccagctatgcgggtgtcgctcaaggtttcggcagcgtctatgtgagcctgtcctccggaacagtcgaaagcatcgatgagcgttccaccactgcgctgtggagcaacgactcgctggcccgccgtcaactgtcggccccggaagtcttctccagctacgtggcggtcggtgacctggaaggttacctgcacctgctgagccaggttgacggtcgcttcgtcggccgtgagcgtatcgacagcgatggtctgcgtgcgcgtccgctggtagtgggcaacatgatttatgtgtatggcaacagcggcaaactggaagccctgaccatcaagtaatggtttgactatgcttggggttgatccccaagcggccttgccccggcaaggttcgcagcacgtcatgtgctgccccgagcaccagccgctgcctcgcagcggcttttgtattttctgaattaacgcagtggagagccgcatggttcccgtaatcgccctggtgggccgaccgaacgtcggcaagtccaccttgttcaaccgcctgactcggactcgcgacgccattgtcggcgacctgtccggtctgacccgtgatcgccaatacggtgaggccaagtggcaagggcgtacctacattctgatcgacaccggcggtatctccggtgacgagcatggcatggacgaaaagatggccgagcagtcgctgctggccatcgaagaagccgatgtcgtcctgttcctggtagatgccaaggccggtttcaccgcggctgaccagatgatcggcgagcacctgcgcaaacgtaacaagacctcttacgtgatcgccaacaaggtcgacaatatcgaccctgacatggcgcgtgccgagttcgccccgctgggcatgggcgacgcgatcccgatcgccggtgctcacggtcgtggtatcacgcagatgctggaaatcgccctgcgcgagttcccgaaagacgacgcagacgagccggaagagggcgaggaagaagtcgtagccgaaggtgaggaagccaagcgcattccgggcccgagcgagaaagacgggatcaagatcgccatcatcggtcggccgaacgtgggcaagtccaccctggtcaaccgcatgctcggcgaagaccgggtcatcgtctacgaccagccgggcactacccgcgacagtatctacattcccttcgagcgtaacgaagagaagtacacgttgatcgacaccgccggtgtgcgcaagcgcggcaagatccacgaggaagttgaaaagttctcggtggtcaagaccctgcaggcgatcaaggacgccaacgtggtgatcttcgtcatggacgcccgcgaaggcgtggtggatcacgacctgaacctgctgggctttgccctggaagcaggccgggccctggtcatcgccctgaacaaatgggatggcatggacccgcgcgagcgtgactatgtgaagaccgagttggagcgccggttgttcttcgtcgacttcgccgacatccacttcatctcggcgttgcacggtactggcgtgggcaacctctaccagtcggtgcagaactccttcaagtccgcggtaacccgctggccgacgagccgcctgacgcagattctcgaagacgccgtaagcgagcacgcgccaccgatggtcaacaaccgtcgcatcaagctgcgttatgcccacctgggtggcgccaacccgccgctgatcgtgatccacggcaaccaggtggagaaggtaccgaagtcctatgtgcgctacctggaaaacacctaccggcgtgtcctgaagctggtcggtacgccgatccgcatcgaattcaagggcggtgaaaacccgtacgaaggcaacaagaacacgctcaccgaccgtcaggtcaacaagaagcgtcgtttaatgacacaccacaaaaaggccgagaagaagcgcaaagacaagcgctgagactcgctgcgggaaccggcttgccggcgaagccctggacctggttcaacgcttcgccggtaagctacttcctacaggatttgccttggaaaaagggcgcctttggcgccctttttcatgcctgtggtttgggctattctcgggacctcccccgagccgccgtagagccgggtgttcagcagggaaccacccatgatcaccagtaagctgccgaatgtcggcaccaccatcttcacgcaaatgtcgcagctcgccgtggaaaccggcgcgctgaacctgtcccagggttttcccgatttcgatggcccgcaggccctgcgcgatgcggttgcccggcatatcgccagcggccacaaccaatacgcaccgatgaccggtctgccggccttgcgccagcaagtggcggccaagatcgcccgcagttatggcgtgcaggtgaatgccgataccgaggtaaccatcactccgggggccacccaggcgatcttctgcgccatccaggcggtgatccaggccggtgacgaagtgatcgtcttcgatccttgctacgacagctatgagccttcggtggagctggccggcgggcgctgcgtgcatgtacagcttggcctgaacgatttcgccatcgattggcagaagcttggcgaggccctgagcccgcgtacgcggatgatcattctcaatgccccgcacaaccccagcggtgcgctgatcagccatgcggaactggaccggctggctgcgctgattcgcgatcgggatatctacctggtcagcgacgaggtgtacgagcatctggtgttcgatggcatcccccacgccagcgtgctggcccatgaggagctgtaccagcgggcattcgtggtcagctccttcggcaagacctatcacgtgaccggctggaaaaccggctacgtggtcgcaccaccggccctgagcgcggagctgcgcaaggtgcatcaatatgtcagcttctgcggcgtgacccctttgcagtacgctctggcggactacatggccgagcacccggaacatgtcgaagagctacccggtttctatcaggccaggcgtgatctgttctgcgacctgctggcaccttcgcgattcagctttacccgggtggccggtacttacttccaactggtggactactcgcagatccgcccggacctgaatgacgtcgagatggcgatctggatgacccgcgagcacggtgtcgcgaccattccggtgtcggtgttctaccaggagccaccgcaaggacagcgtctggtgaggctatgctttgccaagcgtgaggagacgctgcgtcaggcagcggagaagctatgcgtgatctgagtgctttgcccaatctgaatgtggcgctgatccagacctccctggtctggcacgaccgccaggccaatctcgagcacttcgagctgttgctcgaacaggcccggggcgccgacctgattatcctgccggaaatgttcaccaccggattctccatggagtccgaagccctcgccgaggcggaaaacggcccgaccagcaagtggctgcgcagccaggccgccaggctcgatgcggtcatcactggcagcgtgattatccaggccgccgacggcagccaccgcaaccgcctgttgtgggctcgccctgacggcgaggtctggcattacgataaacgccatttgtttcgcatggcgggcgagcacgatcactacacgccgggcgagcgccaggtgcagttcgaactcaagggttggcgggtcaggccgctgatctgctacgacctgcgttttccggtatggagccgcgatgcccgggataccgacttgctgctgtacacggccaactggccgggggcgcggcgccagcactggaaccgtttgttgccggccagggccatcgaaaacctgtgttatgtggctgcggtcaatcgggttggtaccgacggcaaggggtttgcctacaccggggatagccaggtgctggatttccagggcgagaccctgctcagcgccggtgaggccgacggggtattccaggtctgcctgaatgccgcggacctggcggcctatcgcgcgcgctttccagcctacctcgatgcggacaccttcgagttcacctaggcttaaagatctgtcggggtgggccgttaaggggtaagaggattttcagggagatttgtcatgaccactatcggtgccgcgagcatcaatccattcccgctgggggccgcgccgcaaaagctcaacatcgccgagcagcaggccaacccgctcgaggcgcaggacaagagcgctgtcgaagacagcgactcggtgagtgtcgacatgcaggaatacggcgccaaggccgacctcagctcatccaccgctgatatcgtcgcgcagttgcagaagcagatcgaccagacggaaaagaccctgtccgagcagcagtcgcaattgtccggggtgcagaagggccaggcgagcgaggagcagaaggcacaacaggccttggaggtgcaggcgcagatcgcgatcaccgccaacaacctgcaggtgttgcaggcggccttgctccaggcgctgacggcgcggatcaataccaccgcctgagcggggcaataaatacacagcaaaaaaagccccggatcatccggggcttttttgtcgccgtacaccgtcaggcggctttggcgtccagctggctcagggagcggttcagcgcgctgaacagggccttgaagctggcggtggtgatgttttcatcgatacccacaccgtgcaccgcgcgttcgccgttcacccgcagttcgatataggccgcggccttggcgttggtgcccgcgccgatggcgtgctcgttgtagtccatgatttccaccggaaccggcaagccggccaccagggcttccagggcgccattgcccttgccgcgccagtgcaggttggtctcgccctggcccttgccggacacttccacttccacggcgctgtgaccgttttcttcctgcaggcgatggctgaccagcgcgtacggggtgttggcctgcaagtattcgctgtggagcagcgcgtggatctgctgggcggtcatctccaggcccaggcgatcggtttcacgctgtaccacttggctgaactcgatctgcatgcggcgcggcaagctgatgccgtattcctgctccagcaggtaggcgataccgcctttgcccgactggctgttgacgcgaatgactgcctcgtagctgcggccgatgtcggccgggtcgatcggcaagtacggtacttcccacagtgcatcggatttctgctgggcgaagcccttgcggatagcgtcctggtgcgagccggagaaggcggtgtgaaccaggtcgccgacatacggatgacgcgggtgaaccgggatctggttgcactcttcgaccactttgcgcacgccgtcgatatcggagaaatccagttccggatcgatgccctgggtgtagaggttcagggctacggtgaccaggtcgacgttgccggtgcgttcgccgttgccgaacaggcagccttcgacgcggtcggcgccggccatcaggcccagctcggtggcggctacgccggtaccacggtcgttgtgggtgtgcaggctgataatcacgctgtcacgacggttgatgtggcggccgaaccattcgatctggtcggcatagatgttcggcgtggcgacttcgacggtggccggcaggttgaggatcaccttgttggctggcgtcgggttccagacctcgatcaccgcgtcgcagacttccttggcgaactccagctcagtggcgctgaaggtctctggcgagtattcgaactgccattgggtttccggctgctgggcagcgtatttgacgaacagcttggcggcattcaccgcgatctctttcacgccttccttgtcctggttgaagacaatgcggcggaacgacgggctggtggcgttgtacaggtggacgatggctttcttcgccccgcgcaacgattcgaaggtgcgggcgatcaggtcttcacgggcctgggtcagcacctggatggtggtgtcgtccgggatgtggccgccttcgatcagggtgcgcacgaagtcgaagtcggtctgcgaagcggccgggaaggaggcctcgatttctttcacaccgacggcgaccagggttttccagaagcgcagcttcttcaccgcatccattggctcgatcaacgactggttgccatcacgcaggtcggagctgcaccagatcggcgcgcgggtgatggtcttcgacggccaggtgcggtccggcaagttgatggtcgggaacgcgcggtacttcgaggaagggtctttgagcatgctcatggggaaatccttattgtccgggccgaaaagaggcggcctgccggtgaatcaatgggtgtgttgtttgaagcaggggacgaggtaccgcggctcaacctggcagtcgtgcgctgacgaggcagaggcttcggtgttgacggcgctgaatgagggtgtgagaggttttcatgccctcaaccctaaccactggggtgaaagatggcaagcagtcgaaaaaaaatgagataaatctcttaaaaatggttttttgcgagattttattctgttgagcttgcggctggctcgatcttattgcgcagagttttgaacctgcgcaatccctgcgggagccacgactcagggctggaaggccccgataaagatcgccggatcgacccgggcatcgttcaggctgacgttccagtgcatgtgcggcccggtggcgcgcccggtggagccgactttcccgaccacgccgccgcgggccagttgctggccgaccttcacgtcgatcttcgacatgtgacagaacatgctgataaagccctggccatggtcgacgaatacggtgttgccgttgaaaaagtaattgccgatcaggatcaccttgccggccgccggcgtcttgatcggcgtccccgcgggcaccgcgaagtccagcccggcgtgcggattgcgctcctcaccgttgaagaagcggcggacgccgaacttgctcgacagcgggccgctcaccggcttgtccagcagcaggttgctcggggtgttagggctgaaactgcggtaggcgcggacctgctcggccaactcggcgtcgatgcgcttgaggtcggccggatcggggttgacctggcgtttgttcttcagcgtgatgtgctgttccgggtacttcttgctgcccacactgaagttcaggttgcgaccgccagcactgatctgctgggtgccgggcttgacggtcagggggatgccgacaatcgccagccagttgttctgttccttgaccaccagcagcggttttccctggtagctggccttgggcgcctgggcggcgctgcccaggtcgatcaccgccacgccgccgggcaccggtttgttcagcaggcgcgtgatgtagctatcggcgtgggcgttgaaggtcaggcacagcaacagcagggaactcagaaaacgcggcatggatcaatccagtaaagaaagggtgacaggcgtcaggtgattgtcctcgacccggacctgcagttcgccttcgccaagccgggctttgaggcgctggcccagctgggtctgtgcggcgctgcgaatggcctggccgcgttcgtccagcaggatgctgtagccacggcccagggtggccagcgggctgaccacatgcagggtctgcatctggctttgcagttgtaggcgacgggatttcagaccttcgcgcatggcccgtggcaggcgttcggccaggctgtcgaggcgttgccgcagcagcgccagttgccgcccggggtgttggccggcgagccgggtttccaggcggatcaggcgctcgcggcgggtattgaggctgcgctcgaacgcccggcgcatgcgcatgtccaggtcgtccaggcgctgcgcttgctggcgcaggcgctcacctgggtgacgcaggcgccgggccatgccctccaggcgcagacgatcacgcagcagccggtcgcgcatgcgcatcaccaggcgccgatgcaggctttcgacgcggtgttgcaggtcgctggcgtccggcgcgagcagttcggccgccgccgaaggcgttggtgcgcgcacgtcggcgacgaagtcgctgatcgatacgtcggtttcatggcccacggcgctgacgatcggcgtgacacaggcatccaccgcccgggccacggcttcttcgttgaagcaccagaggtcttccagggagccgccgccacgggccaggatcagcgcgtcgaagccccgggcatcggccatcttcagggcgcggacgatctgcgcggtcgcctcgcggccttgtacggcggtcggaatcagggtcagggccacctgtggcgcgcggcgccggaacacgctgatgatgtcgcgaatcaccgccccggtcggcgaactgataataccgatgcgctgcggatgggcgggcagcggcactttgcgttcgctgctgaacaggccttcggcgctgagcttttccttcagcgcatcgaaggccaggcgcagggcgccgtcgccggccggttcgaccgtatcgaggatcagttggtagtcgccgcggccttcgaacagcgagaccttgccgcgtaccttgaccgccaggccgtccttcagcgcctggcgcacccgcgcggcattttgccgaaacagcgcgcagcgcacctgggcattgctgtccttgagggtgaaatacacatggccggacgccgggcgggcgaggttggatatttcgccttcgacccagatgttgctgaacacgtcttccagcaacacccgcgcacggccgttgagctggctgacggtcaggacttcgcggtccaggccgagtcttgcaaagggatctttaatcatgaggcgcagtttaaaggcattcggcaaacaatctccatggatcgaaacaaaaggagacgatgcctttgccggcctcgaatacgccttcggcggttagggcgtgagagcgttatggaagtgttcgatgaactgcatgaccaaaggtgtcggatcttgccgacaggcgagggcgaccgtgctctggcaggccgggtccgccaagggcaggaagtgcaggctggcgggagcgatgtcacgcatcgactcgggcagcagggcgatgccgaatccggcctggatcaactgcaactgcgtggtcttgcgcgacagcacccgcgccgccttggggaaaaagccctggcgcatgcacagctcggccgacaggtaactcaggccgccacgctgcggatggggaatggagataaaggcttcgtcgcgcagttgcgccagatccacgccctgtttgggaggatctgctgccagagggtggcccggcggcacggccagaagcaggcgttcgctgaacagcggcgtgatccgcacgccctcgcgctggcgcagtaccggcagtcgcagcaggccgatatccagccggccttcggcgacttcctccaattgcgcttcggaagacagggtggcgatgtccatcgaaacccccgggcactgctccaggtaaccgctgatggcccgcagcaagcggccgctcatggacacggtgctggagtggctcaggcgcaatgtccccaactgcccctggccgacctgggtcgccagttcgctggccttgttcagctcatcgagcaggttgcgggcgcgcgggtagaacgcctcgcccgccgccgtcagcctgggcaggcgcgcagtgcgctcgaacagcggggtcttgaggtgggtttccagttccttgatctgccggctgagggcggactgggcaatgaacaggcgttcggcggcggcgctgaaactgccgctgtcggcgatttccacgaagtagcgcagttggcgggttgaaatcacgcgtcatgcctttttgagatgagtagatggctttgatgatattagtcgcaaggcttgtggctggctaaagtcattccttgataaagaaggaaggcgaatcgatgagcatggtcgagttgttggggcagtggtcgtgggggacgagtggctggttggcgatcggcctggggatcgccctggcgtatatcgtgtttggcatcgccgggtttggtacggcgctggtggccgggccggtgctgatcctgttcatgccgctgtcgaagatagtcccgctgctggtgctgctggattttgtcgcggccttcggcaatctcctgccgtcgcggcgggatgtcgatcgctccgagctgctgcgcctgctgccgtgcatggcgctgggctgcaccctaggggtgatcttcctgctcaacctcaagtccgatgtgttgctgctgttgatggggctgtttatcagtgcttatgcggtgtacagcctttgggtcaaggcaaggcccaaggcgctggcggcgggctgggcgattcccatggggaccgtgggtggaacgttcggcgcgctgttcggcagtggcggctttttatatgccatctatttgaacagtcgcttgcccaaggatgcggcgcgggctacccagagtgcattgatcagttgcagcacggtggtacgcctgagcctgttcgccattgccggcgtttatgcacagctgcctttattggtgctggcgctgtgcttgttgccggccatggccctgggcctgtggattggtcggcggctgaccatgagattgtctcgcgaggcgttcgtccggctggtgacctggctggtgctggccagcggcatggccctggtcggtcgttacctcagcacttgacctgtggggttcagggattaagctgcgggccctcggatttgccaggcacgccgacttctacacttattggcaggtatcgactcgctgacggtactgttcgagcaggcgacgcagacttcccttcagacgcttcaggccccatccatgaactcgcaaagcatcatcgtcccgaaaatctccaccttgccggttcacgaaccccgcgcccgggcgatcgtgcgttggttggtgcgcaagaacatcgtcgaggaggccttgagcacctgtggtcgtaccggcaatcgcatggcgcatgcgatcgccccaggcgcgcgggaggtggtgctgcacccggaggccttgcccttcggtgaaccggtcaacggcctggagatcattaccaagcgctgcatctataccccggccaaggggtttctcgaggaagcgggttgtgccgagtgccgccaggaagtgggggaggcgctgttcgagagcctggaggactggatgcccgggcgcaccgataacttcacctgccccgagtgcgggcatgaagatgacatcaatggctttctgttcttgcaggagtgcgggttttccaacctcggtttcatcttcaacaactgggccgaagccgggttcaagcagagttttctcgacgagttcgccgaatggctggatcagccggtgagctgggtgaaggtggagttgtaaggggatttcggcagccggttccggggggtgaattcatcatcggcaggtgccatgtctgttcgcgaaacagacgctgcgttccggaaaattccccatccatcaccccgttgataatagacagagttttacattgagcctgggtaggtgtctgagtataatggcgcgcttccattttcccgctcgggagcccccgcgatgctgcgtatcagccaagaagctctgaccttcgacgacattctcctagtgcccggttattccgaggtgcttcctaacgaagtcagtctcaagacccgtcttacccgtggcatcgagctgaatattccactggtttccgccgcaatggacaccgtcactgaagcccgtctggcaatcgccatggctcaggaaggtggcatcggcatcatccacaagaacatgaccatcgagcagcaagctgccgaagtccgcaaggtcaagaagttcgaagccggcgtcgtcaaagacccgatcaccatcgaggctgacgccacggtgcgcgacctgttcgaactgacccgcatgcacaacatttccggcgttccggtactgcacgatggcgacctggtcggcatcgtcacttcccgtgacgtgcgtttcgaaaaccgcctggacgccagcgtccgtgaagtgatgacgcctaaagagcgcctggtcacggtcaaggaaggcgccgacaagaacgacgtgcgcgagctgctgcacaaacaccgcatcgagcgcgtgctgatcgtcgacgacaagttcgccctcaaaggcatgatgaccgtcaacgacatcgaaaaagccaaggcttacccgctggccagcaaggacgatcaaggtcgtctgcgcgtaggggctgccgtcggtaccggtaaagacaccggtgaccgcgttgccgccctggtcaacgccggcgtggacgtggtggtggtcgacaccgcccacggtcactccaagggcgtgatcgatcgcgttcgctgggtcaaggagaactacccgcaagtgcaggtgatcggcggcaacatcgccaccggtgccgcagccaaggccctggccgcggcgggcgccgatgcggtcaaggtcggtatcggccctggctcgatctgcaccacccgtatcgtcgccggtgtcggcgtaccgcaaatcagcgccatcgccaatgtcgccgcagcccttgaaggcaccggcgttccattgatcgccgacggcggcatccgcttctccggtgacctgtccaaggccatcgtcgccggtgcttcctgcgtgatgatgggctcgatgttcgccggtaccgaagaagcgccaggcgaaatcgaactgttccagggtcgctcctacaaggcttaccgcggcatgggttcgttgggcgccatgtcccaggcccagggctcttccgaccgttacttccaggactcctccgcgggtgccgagaagctggttccggaaggcatcgaaggccgtgttccctacaagggcaccctgaccgccatcatccatcagctgatgggtggcctgcgttcttccatgggctacaccggtagcgccaacatcgaagaaatgcgcaccaagccagagttcgtacgcatcactggcgccggcatggctgaatcccatgtccatgacgtgcagatcaccaaggaagcgccaaactaccgcgtaggttgatgcttcaagcaaaacgttaaatgaccggggctgttttattcagccccgagtcgtttctgaatcacgactgttttcgaattacctagacgagactgaatcatggccctcgacattcacgcccaccgcatcctgatcctcgatttcggttctcagtacacccaattgatcgcccgtcgcgtacgcgaaatcggcgtgtactgcgaactgcatccgttcgacatggatgacgaagcgattcgcgaattcgctcccaaaggcgtcattctcgccggcggccccgagtccgtgcacgaagccaacagcccgcgttgcccgcaagcggtgttcgacctgggcgtgccggtcttcggtatctgctacggcatgcagaccatggccgagcaaatgggcggcaaggtcgagggttccgaactgcgtgaattcggttacgcccgcgtcgatgtggtcggcaagagccgcctgctggacggcatcgaagaccacgtcgacgccgacggcctgttcggcctcgacgtgtggatgagccacggtgacaaggtcaccaagatgccgcaagacttccacatcctggccagcaccccgagctgcccgatcgccggcatgttcaacgacgacctgcgttactacggcgtgcagttccacccggaagtgactcacaccaagcagggcggtcgcatcctgtcgcgcttcatcctcgacatctgcggctgcgaagccctgtggaccccatcgaaaatcgctgaagacgccattgcccaggtgcgtgcccaggtcggcaccgacaacgtgctgctcggcctgtccggcggcgtcgattcctcggtggttgcggccctgctgcacaaggccatcggcgaccagctgacctgcgttttcgtcgacaacggcctgctgcgcctgcacgaaggcgagcaagtgatggccatgttcgccgagaacatgggcgtcaaggtgatccgcgccaacgccgaggagcagttcctcaacaacctggccggcgaagccgacccggagaagaagcgcaagatcatcggccgtaccttcatcgatgtgttcgatgccgaatcctgcaagctggacaacatcaagttcctggcccagggcaccatctacccggacgtgatcgagtcggctggcgccaagagcggcaaggcccacgtgatcaagtcgcaccacaacgtgggcggcctgccggaagaaatgaacctcaagctggtcgagcctctgcgcgagctgttcaaggacgaagtccgtcgtctgggcctggagctgggcctgccgtacgacatggtctaccgtcacccgttcccgggcccgggcctgggcgtgcgtatccttggcgaagtgaagaaggaatacgccgacctgctgcgtcgcgccgaccacatcttcatcgaagagctgcgcaaggccgactggtaccacaaggtcagccaggcgttcgtggtgttccagccggtgaaatcggtgggcgtggtcggtgacggccgtcgttacgcctgggtcgtggccctgcgtgccgtggaaaccatcgacttcatgaccgcgcgttgggcgcacttgccttacgagctgctggaaaccgtcagcggccggatcatcaacgagatcgaaggcatctcccgcgtcacctacgacgtgtcgagcaagccgccagccaccatcgagtgggagtgatcccggccgagtgatcggccactgatcgttcaggcaacagcaatggcgatcgagaccttcgggtgtcgatcgccatttgtgtttcagggtctttaaaaaacccgctttccagccctcccgcaataccaggaaagacttgggcccatcgtcgtccgcctggcctgtgtaccctcgacagacattcatcgaacgccctgcggcagcctttggcgatgccggtgcgggtgttgaaagatttcgtggttgtcagttgacaacctcttcattgttgacgagactggaggccatggatggctcgcacacctcatcccaagaaagacattgaaatggcgctgcgctacgccgaatggcagggctggcgcgtcgaagtcggcggcggtcatgcctggggcaagatctactgcccttacaacagcgaggtgtgtcgttgcggcgagttctgcatcaccagtgtgtggagcacgccgaaaaatcccctccagcatgcccgggcgctgtgccgggtaatcgacaactgtacgctgaatcagctgcgcggcgggaaagtcccgcaacctcgtcgggagtcatgaccatggaatacctgtttaccctcaactacctgctgcccgcccacgactgcgacccggacgtgctggtggagcgccttggcgcggggggctgcaccgacgcgctggtcggtaccgggctggcggggcgcctggcgctggagttcagccgcgaggccgaaagcggcgaagcggccctgctcagtgccctgagcgatatcaagcggatcattccggatgcgcgactggtagaggccagcccggatttcgtcggcctgagcgagattgccgatatcgtcggggtctcccggcagaacatgcgcaagttgatgctcaaccatgccggcagtttccccctggcgatccacgagggcagtgcctcgctctggcatctggcggaagtgctgagctggctggcggcccggggcggttaccagttgcagcatccggtgatagaagtggcgcgggtcgcgcaatccgtgaacgtcgccaaggaggcccggcgggtcggcaccccgagcgccgaactggtggcgctgctgggctgagcgggcctgccgcggtggtcagcgtcgggcgacgtccgagaagtagaacttgtccagggtatggcgtgattcggtgtactcgaactgccggccgtcctgcaggaaggtctggttgctgaccactatcacgtggctctggccctccaggtccaggtgctgctggtcatcccgggtgcgtggggtggcttcgatggtccgctgggcgtagctgatctgcaattgcagggtctgctcgatataggcgtagatcgagtgttcggcaatctgccggtccagccccgggatcaactcggcgacgaagtggttgatgtcgagaatcacccgtttgccatcgatacgccgcacccgcttgatgcgggtaatcaggctgccttcctcggcctgcaggtgttcgcgcaacgcgccttcgaggggaaactgggtgaactccaccacctcggtgctgacgtcgttgcccaggcgcggataggtttcctggaagctgacaatgccgcccagctggaactcgatcgggtgcggcgacagcacaaaagtgcccttgccgtggatcttctgggcgaagccgcgctcctgcaactgctcgatggccttgcgcacggtgccgcggctggcctggtagctgtccatcaactcggtttcggaaggcaggcgagcgccgcgttccaggcgctcggtggtgatgctggcaagcagatcgctgtagatctggttgtatttactcatgggatggctctgtgccgtctgcgctcaaggcgggaaccttaagggccgtgagcggatttgtctatttgaggcgagtgagtcgaacaccagactgcgggtgtcgaaatggcaatgaaacaccttacagcagtttaagaattttctgtcgcgcatggcgcgctctgccggaaagtgtggatctagagccgtttttgcgcagaagaaactgcctgcgacctgggtttcggagcgatgccggcaaactcgtctgtacgagttgttgctttaactcgtacagacgagtatttttcgcttcggcgtgctgccaataacaaaaaaccaaagcggaagaacaagcatgagccacgattactccacgattgccagcgagttgctgcacagcctcggtggcgccgacaacctcgaacaagccgcgcattgcgtcacccgcctgcgcctggcgctcaaggacccgagccgggtggacagcgcgacgctgaaccagatcgatctggtcaagggctcgtttttcaccggtggcctgttccaggtggtcattggccccggcgaagtcgaaaaggtctatgccgcgttgcgccaactcaccgggctggccgcttccactatcgccgacgtcaagcagaagggcgccgacaagaccaacgccatgcagcgtctggtgcgggtgttttccgatgtcttcatgccgatcctgccggcgctgatcattgccggcctgctgatgggggtgaacaacctgatcggcgccaagggcatgttcatcgaaggccggaccctgctcgaggcctatccgaccctggatggcgtgtggagcctgatcaacctgatggccaacacctccttcgtattcctgccggcactggtgggctggtcggcggccaagcgctttggcggcagcgaaatcctcggcatcgtgctcggcctgatgctggtgcaccccgacctgctcaatgcctggaactacggcaaggccgtggccgggctggagggccagagcctgccgtacttcgacatcttcgggctgttccagatcgagaaggtcggctaccaggggcagatcctgccgatcctgctggcggcctatgtcatgagcgtcatcgagaaatggctgcgggcgcgggtgccgaatgcgatcaccctgctggtcgtgcccatcaccaccatcgtggttaccggtgtgctggcgctggcggtgatcggcccggtgacccggcacctgggaatactgatcaccgaaggcgtggtcaccctgttcgaactggcgccaatggtcggtggggcgattttcggcctgctctacgcgccgctggtgatcaccggcatgcaccacatgttcctcgccgtggacttgcaactgatctcgacccagggcggcaccttcatctggccgatgatcgtcatgtccaacctggcccagggcagcgcggcgctggcggtattcagcatgagccgcaacgcgcgggaccgcagcatggcttcgacctcggcgatctccgcctatttcggcatcaccgagccggccatgttcggggtcaacctgcgctacaagttcccgttctacgccgcgctgatcggctcggcgctgggctgcattttcctttcgctgaacaaggtccaggcctcggccatcggcgtcggcgggctgccgggattcatctcgatcattccccagtacatcccgatgttcgtggtcggcatggtcgtcgccctggtggtgccgttcgtgctgacctgcggcttgagcatgaagatcatccggccggggtatcgcgtcgcttgataaatcgcatcgcgagcaagctcgctcctacatgaccgcatattcctctgtaggagcgagcttgctcgcgatgaggccctcaaggccagtaccaaccccattgaaggagcccgccatgcaagactggcagcgttcggtgatctaccagatctacccgaagagtttctacagccacagcggccaggccaccggcgacctgctgggggtggtcgacaagctcgactacctgcactggctgggcgtcgattgcctgtggctcaccccgttcctgcgttcgccccagcgcgacaacggctacgacatcagcgactactacgccatcgacccgagctacgggaccatggccgattgcgagctgctgatcgccgaggccgacaagcgcggcatcaagctgatgctggacatcgtggtcaaccacacctccatcgaacatgagtggttccagcaggcgcgcagcagcctcgacaacccgtatcgcgacttctatatctggcgcgaccagccgaacaactgggagtccaagttcggcggttccgcctgggaatacgaagcgcagaccggccagtactacctgcacctgttcgaccatacccaggccgacctcaactgggacaacccccaggtgcgcgccgaagtgttcaagatgatgcgtttctggcgcgacaagggcgtaggcggtttccgcctggatgtgatcaacctgatctccaagccggccgatttcccggaagacgccagcgacggtcgacgcttctataccgacggcccgaacgtgcacccgtacctgcagcagatgcatcgcgaggtcttcgagggctttgacctgatcaacgtcggcgagatgtcttccaccagcctcgagcactgcattcgttactcgcagcccgagtcgaaagagctgtcgatgaccttcaacttccaccacctgaaggtcgattacccgaacctgcagaagtggattcgcgccgatttcgacttcctccagctcaagcgcatcctctgtgactggcagagcggcatgcaggccggcggtggctggaacgcgctgttctggtgcaaccacgaccagccacgggtggtgtcgcgtttcggcgacgacggcgaataccgggtggtctcggcgaagatgctcgccaccgcgctgcacttcctccagggcacgccgttcgtgtaccagggcgaagagctgggcatgaccaaccccggttttacccacatcgaccaataccgcgatgtcgagaccctgaacatctaccgcctcaagcgcgaaaccggcgacaacgaagcggacaacatggcggcgatcatgcagaagtcccgggacaacgggcgcacgccgatgcaatggaataccgaggcccatgccggtttcagcagcgtcgagccctggatcggcgtgccggccaatgccgcggggatcaatgtcgcgcagcagctggaagacccggattcggtgttgcaccactaccgccaactgattgccctgcgccgtcgcgagccgctgatccaggacggcgagtatcgccagctgctggccgagcacccgcaggtctgggcctatctgcgcgagggccagggcgagcgcctgctggtggtgaacaatttctacggcagcgcctgcgaagtgcagttgccggagggagtgatgaccgagcgtatggagcagcgcctggtcatcagtaactacgcagaccatcaaacccgcagtcgcgagctgttcctgcggccttacgagtcctttgtcctgcacctgatcgaccgctgacaaccttccccgcatgagcgcggcgtgcccggcacaccgcgagctttcgctcgccggtagggcggcgcctgcggggcacacacagaataaaaataatggggtggcttatgaaaacaacaataaatcgcggtctcgcagcctcttgcgtctgcctggccttgccgttcccggcccaggccctggagttcgccggttacttgcgtagcggcctcgggacctcggtcaacagcagctcgcaatcctgtttccagctgcctggcgcccagtccaaataccgcctgggcaacgaatgcgaacagtacgccgagctggagctacgccaggacctgtacaccctggacgatggctcggtgctcagcgtcgatgccatggcgtcgctgtataaccagtacgaccgcagcctgaccttccagggcgacaacggctcggcgcgcatgccgcagatgtatgcccaatggtcgaacatgcccagcctcaatggcggctcgctgtgggccggccggcgttactacaagcgcaacgacatccatatctccgacttctactactggaaccagagcgccaccggtggcggtatcgaggatgtgctgatcggcgacctgaaatacagctacgccttctcgcgcaaggacaacctgtaccagaaggactacatcaaccggcacgacttcaacgtcgccggtttcaagaccaaccccggcggcgagctggaactgggcctgagctacatcgacaagcccgacagtcgcgacgcccatcgggggtgggcgatcaccgcccagcatgtgcaaaaggacttcttcggcggcaagaacaagctggcgttgcagtacggcgaaggcccgggcaccgggctgggttacaccggcaatgtgcaactggacgaccgcaacaagagctaccgcctggtggagttcttcgactggcaactgaccccgcgctttggcgggcaggtcgaggcgatctatcagaaagacatccgccccgacggtaacgaccagaactggatctccctgggcatccgcccggcctatgcgatcagcgagcagttcaagctggtcaccgagctgggccacgatcaggtcgaggcccccggcggcacgcgcaagctcagcaagttcaccttcgccccgacctggtcgcccaagggcccggaattctgggcgcgccccgaggtgcgtctgtactacacctatgccagctggaaccaggccgccaagcgcgcggccaatgagctggcggcggggtcggcgctgtccgataccggtgccttcggcaccgccaggcatggtgcgaacgtcggattgcaagtcgagtactggtggaaataagcgatgctgtcggggctcgcgctccatcggcacttacaagaacaaacagcaggtgaagtcatggctacaacccaacaattgcaactgctcgcgccgctgtccgggctgctgatgcccctggagcaagtaccggacccggtgttctcaagccgggtcatcggtgacggcctgtgcatcgacccgacctcgcagaccctgcgcgcgccgctggccggtgtgatcagtaacgtgcaggacagtggccatgcggtgagcatcaccgacgacaacggcgtgcaggtgctgatgcacatcggcctggacacggtgaacctggcaggcaagggttttagccgcctggtgcaggagggccagcgggtcgaggccgggcagccgctgatcgagttcgatgccgactacatcgccgtgcatgcccgcagcttgttgacgctgatgctggtggtcagtggcgagccattcacctggctgacaggggacagtgcgttggtggacagcggccagccgttgttgcagctgagcctgggcgcgcctgcgccaagcgcggagcctgaggaggagggcgaggcgctgttttccaaaccggtgacgctgcccaatcccaatggcctgcatgcgcgcccggcggcggtgttcgcccaggcggccaagggcttcaaggcgagcatctgcctgcacaagcagcaggccagcgccaacgccaagtccctggtggcgatcatggcgttgcagaccgcgcagggtgatgccttgcaggtcagcgcggcgggcgcggatgccgaggcggcgatcaagaccctggccgaattgctggcgagtggttgtggcgaggcggtgaccgcggtgatcgccgccgaacctgtggcgccggttgccgcgccagcgggcaagttgctgcggggcgtctgcgcctcgacgggctcggccttcgggcaagtggtgcaggtcgccgagcagaagcttgagatcgtcgagttcgccagcgatcaggtcgcgcagcgcgggcagctggagcgggcgctggcgcaggccaccgaggccctgcaagcgctgcgggacaaggccgccagcacagcccagggcgagatcttcaaggctcaccaggaactgctggaagacccgagcctgctggagcaggcccagggcctgatcagcgacggcaagagcgcggcattcgcctggaaccgcgccaccgaagccaccgccgagctgttcaagggggcaggcagtccgttgctggccgagcgtgccctggacctgatggatgtcggccagcgggtgctcaagttgctgctgggtgtgcaggacagcgcctgggccctgccggagcaggcgatcctgattgccgagcagctcaccccgtcccagaccgccggcctcgatacccgcaaggtgctggggttcgccacggtcggcggcggggccaccagccatgtggcgattctggcccgggccttggggttgccggcgatctgcggcctgccggtacaggtgctggcgttggccagcggcacaccggtgctgctggatgccgaccagggtgaattgcacctggagcctgcgccggcggtgatcgcacagttgcaggcacgacgccagcagcaacagcagcgccagcgccaggagctggaacagtcggcccaggccgcggtgactcgcgacggccatcacttcgaggtgacggccaacgtcgcctcgctggccgaggccgagcaggccatggacctgggcggggagggcgtcggtctgttgcgttcggagtttctttaccaggaccgcggcgtcgccccgagccacgaggaacaggccgcgacctacagcgccatcgcccgggccctggggccggagcgcaatctggtggtgcggaccctggatgtcggcggcgacaaaccgctggcctatgtgccgatggagcctgaagccaaccccttcctcggcatgcgcgggattcgcctgtgtctggagcgcccgcagctgttgcgcgaacagttccgggcgatcctcgccagcgccgggctggcccgcctgcatatcatgctaccgatggtcagccagctggcggagttgcggcaggcgcggcagatgctggaggacgaagccctggccctggggctcaaggaattgccgaagctggggatcatgatcgaagtgccgtcggcggcgctgttggccgacctgttcgcgccggaggtggatttcttctccatcggcaccaacgacctgacccagtacaccctggccatggaccgcgatcatccgcgcctggccagccaggccgacagtttccacccggcggtgctgcgtctgatcgcctccacggtcaaggccgcccatgtccatggcaagtgggtcggcgtgtgtggggcgctggcttcggaacccctggcggtgccgctgttgctggggctgggcgtggacgagctgtcggtcagcgtgccgctgattccggcgatcaaggccggcgtgcgcgaggtcgagctgagccagtgccaggccctcgccgggcgcattctcggcctggaaagcgccgagcaggtgcgcgacgccttgcaccagcatcggcaatcgacgctggccccttcactggttctggagaactgaacatgttcgagaaattgcagcgggcgttctggaaagccctgaccccggacctggtgcctgaccagccgaaagccacaacccaagccaaggatgacgcagccctgggggaggccgtgattgcggcgctgggcggtgcgaacaacctcaagacccggcaacgtgtggccctgacccgggtgcgggtggagttgcatgacccgaccttgctcgatgccacggccttgcgtaatgccggcgtgcccggggtaatggcgctggtcggcggcgtggtgcatctgctcgtcggcctatctccgatgtagccgctgccgagcgagcgaggctgcgtacggatgcgaaacgtccgcaacccaggcaatgcgttgcacctgagccaccacgttggatgccttggcgggcgctgcgcgcccgtacgcagcctcgcaggctcggcagcggctacaggggggtgacgcctgcggccggtcgccgcgccggccttactgtttctcaactgcgggtgtatcgtattcgccttttgcgggccccggcccgccgcggatacgtgaggtagttgagtccatgtcctttacccgtcgacagatactcggtggtctggccggtcttgccgtggttggcgtgggcgccggtggcgcggcgcgttactggctgggcaagatggccgacgccgaggcgggccacgattatcaactgatcgccgcgccgctggacgtggaactggtgccgggccacaagaccgaagcctgggccttcggcccgtccgcgccgggcaccgagctgcgggtgcgccagggcgagtggctacgggtgcgcttcatcaaccacctgccggtggccaccaccatccactggcacggcatccgcctgccgctggaaatggacggcgtgccgtacgtctcgcaattgccggtgatgccgggcgaatacttcgactacaagttccgcgtgccggatgccggcagctactggtaccacccccacgtcaacagcagcgaagaactgggtcgcggcctggttggcccgttgatcatcgaagagcgcgaacccaccggcttcaagtacgaacgcaccctgagcctgaaaagctggcatgtggatgaagccggcgctttcgtgcctttcagcattccccgcgaggcggcgcgtggcggcacggcggggcgcctgtcgaccatcaatggcctgtcacaggcggtggtggagatcccggccgggcagatcacccgcgtgcgcctgctcaacctcgacaacaccctgacctaccgcatcaacattccgggtgtcgaagcgcagatctacgccctggacggcaaccccatcgagccgcggccgctgggcaaggaatactggctggggccgggcatgcgcatttgcctggcgatcaaggcaccgccggccggcgaagagctgtcattgcgcaacggcccggtgcgcctgggcaccttgcgttcggtggccaacagcgacgcgccgaccgagtggccgccggcgttgccggccaacccgatcgccgagccggacctggataacgccgagaagctcaacttcaacttcgagtgggttggctcggtctcggtgaacgtggacaatggcaagccaccgagcctctggcagatcaatggcaaggcctgggacatcaccgacaagacctgcgccgaccgcccgatcgccacgctcaagaagggccagagctacattttcgaattgaagaacatgactcagtaccagcacccgatccacttgcacggcatgagcttcaaggtcatcgcctcgaaccgcaagaagatcaccccgtacttcaccgacacctacctgctgggcaagaacgagcgtgcccgggtggcgctggtggcggataacccgggggtgtggatgttccattgccatgtgatcgaccacatggaaaccggcctgatggccgccatcgaggtggcctgatgcggcagattcgccccgcccggatcatcgatcgcagccgcgaccaggacttcatgcgtgaagccctggccctggccgcccagggcgcggccctgggcgaagtgccggtgggcgcggtgctggtgcaggacggggaaatcatcggccgaggtttcaactgcccgatcagcggcagcgatcccagcgcccatgcggaaatggtcgcgatccgcgccgcggcccaggccgtcgacaactatcgcctgcccggtagcaccctctacgtgaccctggagccgtgcagcatgtgcgccgggctgatcgtgcattcgcgtatcgcccgggtggtgtacggcgcgctggagcccaaggcgggcatcgtgcagagccaggggcagttcttcagccagggctttctcaaccaccgggtattggtcgagggcggagtgctggccgaggagtgcggcgcggtgttgagcgagttcttcaaggcgcgccgggcgcgctgatccgcccagacgccgcaattacttcctggcgacaatcaccgcgcgcatcggcgccggcaggccttcgatggtcttgctgtggtcgttcgggtcgaggaaatcgctcagtgactggtacttcatccactcggtgccgcgctgttcctcgacgctggtcacgctcacatccacgcaacgcacatcgctgaagccggcacggcgcagccacagttccagggccggcaccgacggcaggaaccacacgttacgcatctgcgcgtagcggtcttccggcaccagcacctgatgccggtcgccttccaccaccagggtttccagcaccagttcgccgcccttgaccaggcagtccttgagcgcgagcaaatgctcgatcggtgagcggcggtggtagaacacgcccatggaaaacaccgtgtcgaagccttccaggttgggcggcaggtcttcgaatgggaacggcaggtgccacactgcgggctccgacaggtaacgctgcaccgcctggaactggcagaagaacagccagttcggatcgacgccgatcacgctgtgggcgccggcgccgagcatgcgccacatgtagtagccgttgccgcagccgacatcgaggatgcgcttgccttgcaggtccaggtgcttcgcgacccgtgaccatttccagtccgagcgccattcggtgtccacatgcacgccgaacaggtcgaacgggcccttgcgccagggcgacaggcccatcagcgcgctgcgcatctgggcgcgggtggcgtcgtcgcagtcggtgtcgagggtcaggccattgagcaggtcgatggtgctcggctggatcttcggcagcgcgtccagcgcgctctgccagcgctccaggtcgccgtggcccttttccatcttggtgtcgagttgcgcttgcagggtgttggcccagtcagccagcggcgtaccggccagacggcgggcgaggggggacagatcgatcatggcaaggcaatcaacgaggcaaagttaagacactggaaccacggcacgacttttgagaacccggcggccagcaggcgttcgcggtgttcttcgaggctgtcgggcttcatgacgttttcgatggcgctgcgcttctgggcgatttccagttcgctgtagccgttggcgcgcttgaaggcgatgtgcaggtcggtgagcagcgcatgctcctcggggtcgttgaagcgcagtttctccgagaggatcagcgcgccgccgggcagcagcgcctggcgaatgcgcccgagcagggccaggcgctgttcgggggcgatgaattgcagggtgaagttcagcgctaccaccgaggccggctggaactccagggcgaggatgtcgccttcgatcacttcgaccggcaacagctcctggaacattgagtcctggccgttgaggtactcgcggcagcgctcgaccatggccgccgagttatccaccgcgatcacccggcagccgtcggtgcgcacatggcggcgcagggcctgggtcacggcgccgagggacgagcccaggtcgtagagcacgctgttgggctgggcgaactgggcggcgagcacgccgaggttctcgacaatggtcgggtaacccggcaccgagcgcttgatcatgtccgggaacacccgcactacgtcctcgttgaaggcgaagtcgggcacctgggccaggggctgggcgaaaaggcggtcgggttctttgctcacggcggttccagcggtggagatagaaagaggggcggcattgtagccgctgacgcaggctgcgataaggcccgaagggccttcggggctgtaagggcgacacaaggcgccgcccgctggattccccgcctgtggccctgtagccgctgccgagcccgcgaggctgcgcacgaggacgcagtcctcgccaagcctgtgcatggggtttatctgaagagccgtggcgactggttttacggccgctgcgcagccgatcgcagcctcgcgggctcggcagcggctacaggttcagcggggcttctggcggaaggccgaggctgcaatcccccattgccccagccagtaactgaggatgatcaggtagggcgcggcatcgaaggccaccacaaaacggctgatgccgatcacgctgtcggagaacacgaaggccacggcgccggcggcggccagttgcgccgagcgcttgggcacctcgctgcccaagcgagccagggcgcgccagagcatggcgctgatggccaggccgtagacgatcaccggcaccagcaacgggccgaggccatggctgatcaggatgcccagcaacgccgcgccgacgaccagggccagcagcaggggcaagggagccaggcgccggcaatcgctggtataggccttgagataggccaggtgcgcgaccaggaaggcgccgaggccgaacacgaacaggtcggcgggccaggccagcagcacatcgccgagcagggagaacaacaggccgaggctgatccagcggcgatagtcgctggggggcgcatcgtgcaaccagccgagcagggccagcaccggcagcggcttgaccagcaggcacagcagggtggcgtggatgctcaggccgtagaggaaggtcaccgcgcccatcagcgccaggatcagccagcccatgtcatttgaccgaaatggcgcagtcgaaggctttcaccggcgcgacttccggagcccagggctgttgataggtcagcagcaggcgcccggtgccggtggcgaaggcctggaagcgccaggtggactggccggcgctgcccaccaggccgctgtcttcggggttgctgtagacctcggggctgattttgcgcagcacgccgccggccgagtcctggatcgcccagcgataacccgtggtcgggttgctcggcagggtcaggatcaggttttgcccgttgctcagttgcactgggcattcgctctggttctcgaccgtgacgttgtgcttgggttggctggcgcaggcggcgagcagggcgaggctgaagggcagcaacagacgaatcggtgacatgggtcagaaagctccggtcatgacaaagggcgagcataaccgaagattgaggaatatgtggtggggcaggcagacgttgtaggagcagccggtcgacgctgctcctacatatctgcgtttagaacagcactttcgccacatcggcgaaacgcttggcgaagtgcacggtgatgccttccttgaggtagtccggcagctcttcgaagtggccgcggttggcttccggcaggatcagctcgtagagcttctgccggcgcgccgcgatgaccttctcgcgcaccccgccgatgggcaggacatgcccggtcagggtcagctcgccggtcatggccacgccctttttcggcggctggttgcgcgccagcgacagcagggcgctggccatggtcaccccggcgctcgggccatccttcggcgtggcgccttccggcacgtgcaggtggacgaatgcctcgtcgaagaacttggcatcgccaccgaactgcttgaggtgcgaggtgacgtagctgtaggcgatttccgccgattccttcatcacatcgcccaattgcccggtgagcttgaagccacggttgagggtatgaatccgcgtggcttcgatcggcagcgtggcgccgcccatgctggtccaggccaggccggtgatcaccccggtgccgctgagcacctgctcgttgcggaacaccggcatgcccagggaggcttccaggtccttggtgccgagcttgatcaccgcgtccggatcttccagcagccgcaccacggccttgcgcaccagtttgcccagctgtttctccagctggcgcacgccggcctcgcgggcgtaaccatcgatcaccgcgcgcagggccgcgtcgctgatactcaggttggccttggacacacccgccttttccagctgcttgggccacaggtggcgcttggcgatggccagtttttcctcggtgatgtagcccgacaggcgaatcacttccatccggtccagcaacgggccgggaatcgaatccagggtgttggcggtgcacacgaacagcacttttgacaggtccaggcgcaggtctaggtagtggtcgaggaattccacgttctgttccgggtcgagggtttccagcagcgccgaggccgggtcgccctggtagctctggcccatcttgtcgatctcgtcgagcatgatcaccgggttcatcacctcgacgtctttcaacgcctgcaccagcttgcccggcagggcgccgatgtaggtgcggcggtggcccttgatctcggcctcgtcacgcatgccgccgacgctgaagcggtagaacggccggcccagggattcggcgatggacttgccgacactggtcttgcccacgccgggcgggcccaccagcagcacgatggagccgctgatctcgcccttgtaggcgccgaccgcgaggaattcgagaatccggctcttgatgtcgtcgagcccggcgtggtgctggtccagcaccttgcgcgcatgcttgaggtcgagcttgtcctcgccgtacacgccccagggcaccgcggtggcccattccaggtagttgcgggtgaccgcgtactccggcgagccggtctcgaggatcgacagtttgttcatttcctccacgatgcgcttttgcgcttgaggaggcaggaccttgccagccaggcgctgctcgaactgctcgatgtcggcgctgcgatcgtccttggtcaggcccagctcctgctggatgaccttgagctgttccttgaggaagaactcgcgctgatgctcgccgatcttgcgattgacctcggcggaaatctctttctgcaggcgcgcgacctcgacttccttgcgcagcatcggcaggactttttccatgcgcttgagcatcggcacacagtcgagcacttcctgcagttcgttgccggtggccgaggtcagcgcggcggcgaagtcggtcagcggcgacgggtcgttggggctgaagcggttgaggtagttcttcagctcttcgctgtacagcgggttgagcggcagcagttccttgatcgcattgatcagtgccatgccgtaggccttgacctcgtcggtcggctcgctcggctggtgcgggtactcgacctccaccaggtagggcgggcgatggtgcttgagccaggtgcggatgcgcacgcgggtcaggccctgggccacgaactgcaacttgccgttttcgcggctggcgtggtgcaccttgaccagggtgccgtacagcggcagggccgaggtgtcgaaatggcgtgggtcttccggcggggtgtccatgaagaacagcgccagggaatggtgttcggacttgctcaccagctccagggtttcggcccagggttcttcgttgacgatcaccggcaagacttgcgcggggaagaacggccgattgtggatcgggatgatgtagaccttgtccggcagattctgcccgggcagggccagacccttgccggaggaggtatggagttcggcgttttccgggtcggcgtattcactcatggtttcaggaagttcttgctggtcgctcatggggcacctgcgcaatggggtatgcgaagttagatggggcaggtgacgagcggtttcaatggtgcccgggccggatcaattatttcagtccttgtcgccgcaacgcagggcagcctccacagcgctgattgtgaggctgtcatttctgcgcaagaacgttggtaaattggcggtgacaaaaaaatgactttatgaaccccctgattttattgcgtgatcttcttctcttggcagtctaatctggaccgattaaatgttgtcagggaaatggcatttatttgacgcatctttagctgcccagagggacgcgtaatgatcaaaggacttttcagcggggagcggcgggtgtcgccgtgggggtgcaggggcgacaacagtgaggtcgcggcgacgagagccgtctcatgaagtggcgccatacgttccaggtaaggatcactggggtattggcgttgttgctgttgatcgtgatcggggtggtgtatttcgccgtcaaggccgcgaccaatcatgcggtggaaaaccaggcgcaagtgcagctgcaaaccggcacccgggtcttcgaacgcctgctggaactgcgcggtcggcgcttgcgttatggcgtggactggctggtggtggacgcgcagttccgtgaggcggtgatcagcggcgactcgcgggcgattctcgaggcgctgcgtcagcatggtaccggcacccgcggcagcgagctgttcgtgctcggcgccgaaggcacggtgatcgccagcaccctgggggcgatcgccgagcgtgagcatttcccctacgaccgagccttgcgcacggccctgcggcagaacaaaagcatgttgatcgtcgcgctcaagggccagccttatctgttggtccaggggcaggtactgacgccgatgcacatgaatcgggtggtcatggcgtttcgcatggacgacctgttcgccagcgagttgcgttccatgagcaacctggaggtgtccttcctcaccctgcaggacgggcgcgcgggggagctgttcagcactcagccggatattttctgggcgaccatcatcaccaccctgcgcaatgcgtcctggcgcgcgcgaccacagttgagcgatgcccacggcaagcgcttcctcaatcaggccctgcagctggccaataccgacgatcccgacgaccccaaggttctggcgttgctgcaaagcccgttggatcacgccttgcaggccttcgcgccgctggaccgtgagttcctggtgattgccctggcggcgctggtggtgtcgctggccggcgccctgttcatggcgcggcgggtgtcgcggccgttgaatgtgctggccgatgccgcccaacgcatcggcgccggcaactaccaagtgccagtggtgctcaagcgcaccgacgagttcggcttgctggccgaggcgatcaacgccatgcagagcgggattgccagccgcgagctgcaactggcccacaacgccctgcacgatcccctgaccggcctgcccaatcgggcgctggccatggagcgcctgagcaacgccatcagcgccgggcgcaaggtggtgctgctgtacctgggcatcgaggactatcgggcgatcaacgaaggcctgggcccggaaggggtggagcaaatgatgcgcgaagtcagccggcggctgtcggagacggtgtccaccggtgacaccgccgcgcgcatcaccgccaacgagtttctgttgctgctggaaaataccgagatcgatggcgcggtggccatggccgaccggctccatgcgttgttgagccggccgcagcccctgcgtggcgatgaagtgcagcgccaggtgtgcatcggcgtggcggtctaccccaccgacggacaatcggcggaagaactgatcagccgcgccgccatcgctcgccacgacgcggccgcccagcccggttacctgcagatctaccagcaggatcgcgacctggcccatcagcgccagatcggactgatccgcgacctgcgccgggccgcggcggaaggtgagctgttcttgctgtaccagcccaagctggacctgcggcacggccatgtgcaccaggccgaagccctgctgcgctggcagcatccggagttcggcatggtctcgccggcggagttcatccccctggccgagcggaccggcagcatgaacagcctgaccctgtgggtgatcgaggagggcatgcggcaactggccgaatggaacatgcgcgggctacatctgcagttgtcgctgaatatctcggcggacgacctgcatggccacgacttggcggcgcgggtgagcgtgttgctgcagcgttatcgattgtccgccgagcagctgattttcgagatcaccgaaagcgccatcatgcgtcacccggagcaggcgctggaggtgttgcagagcctgcgcgactgcggcatcagcctgtcggtggacgacttcggcactggctattcgtcgctggcgcaattgcagcggctgccggtgcaggagctgaagatcgaccagtcgtttatccgcaacctcgacgaaaccagcggcgacgcggtgatcgtgcgttccaccatcgagatgagccacaacctggggctcaaggtggtggccgaaggggtggagcaggagcgcagcctgcgcctgctggagcgctggcattgcgacacggcccagggctacctgatcagccggccgctgactgccacagccttcgaggcctggctgttgaagtcgcggatttccagctgagcagccctgtgtggccgcaccgggcgctgcagccagagatctgcaggccctgcttcacggggtgaagtctggcgccatgaaccctcggcgatgggccgcggcttactgcttggtgcactctgcggggagtgccacgacgccgcccatggaggcgaaggcgaccatgccgccactgggcaatacacaattgtattcgccgttgctggtgctggcagtgaagtaagtctgggacgcgtcgctacgcacattggagaccgtggtcacgggcttgccgagggtggtctgggcgcggttcttgaggtcgtcgttgctgggtttggcaatggcgcaaccgcccagggcgagcgccaggatgccgagcagggcgaggggacgagcagtggggtggaggttcatggtgattcttccttggcattgttgtgttttctacggcgcagccgaccccgacaccgcagagcggcggtgttgagaagagcgagtgagtggttggcactatatcgccggggtgggggagggtcgattagcacagatgggctaatgtccctttgcaatgaccgggttgaggacggcgtcggcgcagggccggctggagtcgccggccccggatcgaggttcagctcagcagttgttcctgcaggcgccggccgagtacgtccagcaggtcgcaaccgtcgcgcagggggatgacgcagagctgggcgaaatcctggagcagcgccgggttgccgtgcaggttggcgtcactggcgaggttttccagcaactgggccgcggcgcggatgcggtgggcggcggcttcgtgcagcacatccaatggcgcctcggtgtcgatcagcaaggcggggatggtgcagtcgttgctggtcagggccatgtagcggcggggtgaggtgtcgtcgatgagcgcgggtggatcgggagtgagttttttcattggtctgttcctaacgtatgagtcggagtcgccagaaatcacttccacgtaatcaggtggcggctgtacgcaggtgtggaagaccgggacgttaggcacccggcgcactcgagagtgccccacgcacagccaccataaagtgcaggcgaaaaaacgcctgactcacgttgctttgcgcgcctaacgatataagggcttccacaccctgtcactgagtttgcagtgacaggccaaaccatagagtccggggcccggcgggacaaggtgatgggagtcgacgcgtgttgtaggaattttcgctataaccactgccaccaccgatctcggctcgacattggccctgtagccgctgacgagcccgcgaggctgcgataaggcccgcagggccttggttcccgatcttgcgccaaactccctgcagccttcagaacgccacggccgtaccggccgatcgcagcctgcggcagcggctacatgaatctctatcggccttgagatcgccgttcgacggccaccaccgatctcggctcgacattggtcctgtagccgctgacgagcccgcgaggctgcgataaggcccgcagggccttggttcccgatcttgcgccaaacctccagaggccttcagaacgccacggccgtgccggccgatcgcagcctgcggcagcggctacatgaatcgttatcgcccgggaggctggtggtggttgggcgggccctatcgcgagcaagctcgctcctacaggtattgcaccgtccttgtaggagcgaagcttgctcgcgatgacgtcaggccgggcaatacaaaaatgaaaggccgaagaggctccctccaaacgccacccacaaaaaaaggcggctacccgcaggtagccgccttttcattcaccgccggtaacgcttattccgacagtttgtaggcgatgatgtagtcgcccatcttggtgcccagcgagccgtggccacccacgaccaccagcacgtactgcttgccatccttgccggtgtagctcatcggcgtggcctggccgcccgctggcaggcgggatttccacagttccttgccgttgttcacgtcataaccgcggatgtactggtccagggtgccgctgaggaagcccacgccgccggcggtgaccatcgagccgcccatgctcggcacgccgatgggcagaccgatcggtaccggcgagctgtcgcggctggtgccgttcttgtgcttccacaccactttgttggtggtcaggtcgataccggccacgtagccccaggccggggcctggcaaggtacgccgaacggcgacatgaacggatgcatgatcaccgcgtacggcgcgccggtgttgggttgcacaccggaggtttcgctttcgcgcttgctgccggcggcgacttcggcgcgcggcaccagcttggaaacgaaggccatgtagttcgggctggtgaacagcaggtggcggaccgggtcgatcgacacgctgccccagttgaacacaccgacgttacccgggtagaccaggctgccctggatcgacggcggggtgtactggccttcgtagcgcagttccttgaactggatgcggcacagcatctggtcgaacggcgtggcgccccacatgcctttttcttccagcggcggcggcagcaggttcaggtccgaacgggcctgggtcggcgcggtgtggtcaccttcgaccgcaccgcccggcgccggtacttcctggatcggcacgatcggggtgccgtcgcgacggtccagcacatacaggctgccttgcttggtcggctgaatcagcgccggtttgatgccgtccgcggtcttcatgtccaccagggtcggctggctgcccacgtccatgtcccacaggtcatggtgggtgaactggtagttccagcgcagcttgccggtgtcgatgtccagggccacggtgccggcgctgaacttctcggcgcccgcggtgcggttgccgccccattggtcaggcatctggttgcccagaggcaggtagaccaggcccagcttctcgtcgacgctggccagggaccacatgttcggcgagttgcgggtgtaggtctggccttccggcagcggcgtggtgacgtcggggttgccggcgtcccagttccacaccaggtgaccgtcgtgcacgtcgaaggcgcggatcacgccggacggttcgttggtcgactcgttgtcggtcacgtggccgccgatgatcaccaggttacgggtgatggcggccggcgacgtcgagtagtagccgcctggagtgaacgggccgataccggccttcaggtccacggcgcctttgttgccgaagtcttcgcagaccttgccggtgtcggcgttgatcgcgatcaggcgcgcgtcggcggtcggcaggaacaggcgacgcgggcagctggcggcgatcgcctggccggcggccgagaggctggccggggtgctgatggcgtcgcttttgttgaagctggcttcgtcgtagtacgacacgccgcggcaggtcatgtgtgcccaaccacggaagtcatcgccgttcgggccctggattttcgggtcgaaacgccagatttccttgccggtgtccgggtccagcgccagcacctggctgtgggcggtgcaggcatagagcatgccgttgaccttcagcggggtgttctggttggtgatttccaccgggtccttggcggtcggcatgtcgccggtgcggatgcgccaggcttcctgcagcttgccgatgttggccggagtgatctgggtcagcggcgagtagcggtcaccgaactcggtgcggccatatgcctgccagtcgccttcgggcatggtcggcgcggcgctggtggtgtcggcgcttgcacggcccagttcgcccgagatctcgcccggattggtgaactggctgttgatcgcggcaccaccggccaggaccacggccacgcccagtaccgcggtgctcacaggcgccgggccgttgcgcagcagcggacgacggaaccatggcagcagcagaaccacacccagggcaaagaacagcgacaggcgtggcaccagttgccaccagtccaggccgacttcccacagtgcccagacggagctggcgaacagcaccaccccgtagacgagcagcgcggcactacgacccgccagcagcagcacgccgctgacgatcaggccgataccggccaacaggtagtacagcgagccgccgagcatgctcagcttgatccccccggccagcatggccaggcccattagcagcagcaagataccgagcaggctcggcagcaggcggctcggacttgaagcaccctcagtgctcatagtgtggttctccgtgacgtttaaggtagtcccgcgcttgttcactgtagatgacgatcaggcgcgggcatggttcagcagtgtttgggaaaaacagttttattcagattgggcgatccccagggcttatcagaacgagctctggatcttgatcccgccgatcagcgcgtcgtcgaccttgtccacgccacccgggtggcggatgtattgcaggttcgggcgcacggtcagccaattagtgacatgcacgccgtagtacagctcggcgctgtattcggtgtcctggggcggcaggtaggccgggttgtcgtagtcctggatgaggttggcctgattggtcgcttcggcgttcttgcggtaggccgggttgacgtggacccgggccatggcgaaaccgatgtcgtccttggcgcgtgcatcgaacaggcccttgtagaccaggccggcctggacgtagttgtcgatggcgttggtcttcttgtcgtgcatcgtcgcgttggcgaacaggctcaagccgcgcgagtggtcgctggccaggctggtgatctgctgttgcgcgcccagccacaggccgtgcttgctcgagctgctgcgataggcctcgccgctcaaggccgccggctggccgttgctgtccttgtacacgtcgctggccttagcgctgctgtagtagtagccggcgcggtattcacccggcaggccattgagcttcggcgtccacaccagctccaccggcagcagggtgccctgggtgccgctgccgctgagcttgaagccgttgccgcgctcgaggttggacgggttctgctcataggcgccgatctgcgcgtagagctcaggggtcaggtgatatttgacccgcagcgcccactggctgaccggccagttgtaccagacgctaccggcccagttgccaacctgggagccgcagaacgcgaggttctggaagtcgcaggggaagctgttgaagtcttcgccctggccgaaccggccgaccttgatatcgagtttctggtcgaagaatttctgctggtaccacatctgcgtcaggcgccaggtctggccgcggccccagacttcctgggccgaggtgaagccaccgacccgcgggtcgttgatgcggtcgttgctgatgttgtcgccgtcacgcttggtgatggtcagttggaactcggcgtcgttccagccgaggatcttgcccagatccaggtggctgccgaaggcgaactggtcgctgaagcgcgcggtacggtcatggtcgtaaccgccatgcaggttggcgcccatttcgccgacgaagtcgatcttgaagtcgtagccttttttcgccagctcggtgcggttgccattccagtcgccgagcatccacggggactcactgtcgaaggccggcgcagcttgggcgcaggtagccaggccgagggcgccgagcagggtcatggtttggtgcagggcggcagggcgagagacagcgctgtctttaaaggtttgaacgtctggcataggtgaagtcttggtcttattcaaggaaatgggcaggcaagcaaaggctcgacgtggctcggttcgcggcagtgcgagcacgttaatacagctgattcaaagggcaggattaaaggtttcagcctgagcggcgcgaagaataaatcaggggccaggcgagagaaagggcttttgttgacatgaatcatttcggattcggtaacagtactgcctcgccgcctggagcacagggcctgctggcgcggtgaacgccaggaaagccgtagcgcgacggcccgttgcaggccgtcgcgggtcagagcctcagaaggtcgtgcgcaagccgacctcgatgctgcgcccctgggccggggcgatgtcgcgcaggatcgagctggcgtagcgcacggtctggttggtcaggttctcgcccttgacgaaggccagccactggctgctgccgatgtcgaagtggtaaccggcgctggcgcccagggtggtgtagccgtcggtgccgctttcgttgtccggcacgcgacgctggctggcggcgtgttcgacatcgatgcgtgcctgccagcgatccagttcccacagcaggccgctgttcaggcgcagcggcgcgatgcgcggcagggcttcgccgttgtccaggttcttggcgcgggtgtagtcgccggacagttccagggcgaacttgccgtaggcgctttcgccgagcttccagtggtcctgggcctcgatcccggcaaaccgcgcgcggactccggagtaggtgtattccggcataccgccggcgtcttcctcgccttcatcgttgagggtgcggccgctgccgagcagcccgatgtagttggagaagtggctgtagaacaccccgacgctgcctttgtgggtgccgttgtcgaaacgcagggccaggtcgctggatacggctttttccttcgacaggttggcgtcgccgacttcataggtgccggtggccacgtgggcgccgttggcatacagctcgtagaaggtcggcgcgcgttcggtgtagcccagggtggcggccacggaccagatcggcgtcagggtgtagaccgcgccggacgacaggctgccggcggtgaaactgttggagctgtcggcctggctgaagcgctcgttgcctttgctgtccgggtcgacgcgggtgtgttccaggcgcccgccgaggctgagtttcaggcgttcggtggcctgcaattcttcgaggatgaacagcgcggcgctgtcggtatcggtctggggtacgaaggcttcctcgccgagcgcggaaaactcgctgcggctgacctgggtgccgatcaccccattgagcgggccgaggggctggtggcgcgcttcgacccgggcttcgtaacccttgttcttgaaaatggtgccggtctcgccgccttcgatttcgcggtgctcgtaatcggtgtagccggcgtcgaatttcagcgagctgaaagggccgtcgaggttgcgcagttccgaggcgaaggcgtagtgatcctgcttcatgcggatgcgcacgtcgtcttcggcgggcgagccgtagttggagtcgtagttgctgtaggacagcccggcgtaaccgtcgtcccaggtgtaggaaccgccgatggcgccgccgtcctggcggccgtcgctgttgcccaggcggccttttttgccgtcaccgtcttcactcgctggggcgtggcggctgcgggcgtagccggggattttcaggtcgttgaactgccgcgagttggcgtccaggtgcaaggcgaaggtgccgttgccggcttccagcttgcccgcgctgctacgggtggtgtcggcaccgccataacgcaattcaccggcaccgtggatgccttcgatggcggcggtggggatgcggttgtcgaaggtgttgaccacgccgccgatggcgctgccgccatacagcagggcggccgggccgcggacgatctcgatgcgctcgacgttgactgggtccagcggcacggcgtggtcgtaggacagcgacgacgcatccagggcgccgacaccgttgcgcagcaggcgaatgcgatcgccgtccaggccgcgaatgatcggccggctggcgcccgggccgaagtaggaggaagacacgcccggctgtttattcagggtttcgccgaggctgccttgttgttgcagggtcaggtcgtcgccttccagtaccgtgctcggcgctgccgtttgctggctgcccagggggttggcggtgatgacctgcggttgcagctccagggcgtgggcctgggaggcgaacagcaaggcggcggacagtggcgtcaggcgccagagtaaagagcgagaagggcggggggcagagagggacatcggtcattccttggcaagcgcgaggctgtgcgctttgagtcaaaagagaacaggcgtgacacggcgaggtgtctggatcaggggtttgttttgtattgatacaatataacatctcttttgacgcaaaaaggaaggaactttttcaggagaggggggcattcgttccgatgtagccgctgccgcaggctgcgatcgagcggaacgctcgcggcgatctcaggtgcatgagcgccttcggcgctatcgcagcctgcggcagcggctacagttgatgagtgttcgcccttccaccggatcgaaccctcggctaaggtgcgcgacttcctttttctcttgctcaaaggcccggcatgactgcaacgaacaacgacccgctgcacggcgtcaccctggaacagatcctcaaggcgctggtggaacactacgaatggcaggggttggccgagcgcatcgatatccgttgcttcaagagcgacccgagcatcaagtcgagcctgacctttctgcgcaagacgccctgggcgcgggagaaagtcgagcagctgtacgtgaaattgcagcgcaccaaacgcccgctctaaggaccttcgatggctgtcgagccggtttttccttcaggcggcaaacggctgttcaccgcgctggccgcgttgctcggctggttggggctgacgatccagctgtacctgatccttcatctgcgctggacggtggacgccagcctgctgggcgggctgatcaactttttcagtttcttcaccgtgctcaccaacaccctggtggcggtggtgctgacctgcgccttgaacctgcgcagctcgcgcgggcagcggttctttctgcaaccctgggtcagcagcggtatcgcggtcagcattgtggtggtggggctggcgtacagcctgttgctgcgtcacctgtggcatccccagggctggcagttggtggcggacgagttgctgcacgacgtgatgccgctgctgtttctcgtctactggtggtgctgcgtgcccaaggggcgcctggggctgcgacatgtcgccgggtggatgctctacccgctgctgtacttcgcttatgtgctgctgcgcgggcacgtgctggggctgtatccctatccttttgtcgacgtggacaagctgggctatgcgcaggcgttcgtgaatgcgctggggattctggcggggtttgtgctggtggcgctgttgttcgtggctgtggatcgctgggcggggcagcgcagggcttgagtcgttgggtgacggggagattgttatcgcgagcaagctcgctcctacagggctgttacgcggacattgcaggagcgagcttgctcgcgataggcggccaggccgccgcttttattcgtcctcgctactgtccaggcgccaataaccggcggccttgacgaactcgtcgtcgagccggtgttcgtccagcagcacccggcgaatctgccgtgagactttgctttccgtggccacccaggcatacagcttgccgctcggcacctgcagcccgcgcacggtactgatcaggtcctgctggccgccgtcgcgctcgacccagaccacctcgacctgcgccgcgctcgccagcacctggcgctcggcggcgtcctggatctcgatcaccgccagcacccggcgcccggccggcaattcttccaggcgccgggcaatcgccggcagcgcggtttcatcgccgatcagcaggtagctgtcgaagatgtccggcacgatcatcgagccgcgcggcccgccgatatgcaggaactgaccgggcctggcctgctcggcccaggtcgaggcagggccgtcgccgtgcagcacgaaatcgatatccagttcaccgatgtccaggtcgtagcgccgtggcgtgtagtcgcgcatggccggcatcgcgccgttgtccttgcccgggcccagcaccagggtttccagggccgcctgctgttcggcgttctgcgggaacagcagctttatatggtcgtcgctgcccaggctgatgaagccggcgagttccggcccgcccagggtgatgcggcgcatgcgcggggtcaggtcgaccacccgcagcacttccaggcggcggcgtttgatctcgtggctgacccgatgaatcgttggcgaagtgtctgcggtcattcagctgactcctgagtggaagaaggggccgggccgtcgacgatggcgcgggcggtgttgttcagcaggtcgcggacgcgcaggatttcttgcgggttccagcggccgtggtgcatctgcagggcgtggcgcaggttgtgcaccgcctcgtggatttccgccgggcgatcgtggccgcgcagcgagcgcttgctgacgtcgatgcgcatgcgcacgccatccagggcaattgcctggtcctgtaaggacagacggccggcctcggtcacgctgtagcgttttttcccgccttcggcgtcgccgctgatcagttcgctctcttcgaggaaggtcagggtcgggtagatcacgcccgggctggggctgtaggcgccatcgaacatgccttcgatctggcggatcaggtcgtagccgtggcacggctgctcggcgatcagcgccagcaacagcaacttcaggtcgccgggggcgaagacccgcgggccacggccgccgcgttcgcgcccggggcgtttttcgaaaccgtcgtggccgtcgccgtactcacggtgggggtggtgttctctcattttctctttctcctgtgcgattaagacataacttaagatatatcttaaaggctgcgcaagtacttccgtgctggccgcatcagccgtttgtcgcagagggggagaatcgagacagtccgtagccgctgccgagcttgcgaggctgcgatcgaggacgcagtcctcgcaaaacggcctccgcagtgatacctggagcaacggggttgttgcggccgctacgcagccgatcgcagcctcgcgggctcggcagcggctacaaggcggctacgttgcggggggaggtttcagcgttgggccaggctgcccaggcactgggtattgctgcccggttgcaggtacggcgtgaggatcggcgccatgcccttgagcacctggactggcaaggccgaggtgaacttgaaggcttgcgccgagacgcccggcacataggcggtcagggtgccgaagtggtgttcgccgatatagaacacgaaggtggcggtgcggttgatggatttcgaactgaggatccgtccgccggagccgatggcctcgatacggttgtcgccggtgccggtcttgccgcccatggccagcggcgtgccgtcggccagcttgaagctgccggagaggcgcttggcggtaccggcatccactacttgcgacagggcgccacgcagcgccgtggccacttcagaaggcatcacccgcttgccctcggccgggtcgttgaccagcttggtttcatacggcgtatcggcggcgaagtgcaggctgtcgatgcgcagggtcggcatgcgcacgccgtcgttgagaatggtgccgaccagttcggccagcgccgcggggcgatcgccggaactgccgatggcggtcgccagcgagggcaccagatggtcgaacggataaccgactttctgccagcgctggtgaatgtcgaggaacgcctcgatctccagcatggtgcggatgcggctgtcccgcgcgctcttgtgccggctcttgaacagccagctgtagacctcctggcgctcgaattcgctggctttgacgatctcgctgaacttggcgtcggggtggttcagcaggtagccgagcagccacaggtccagcgggtgcaccttggcgatgtagccctggtcgggcaggtcgtaggagccggggccgtagctgtaatagagcttgtccaggcgttcgtcggtgagtttctccgtgagcttggcgcccttgaggtgcgagcgcacgaaactgttgaaactctcctggctggcttccggcagcaggtagcggtgcacggccgccaggcggatcggcgtcgggtgcatgctgtcgaggaaggtgtccaggcgcgcttgggtgtccttgttgcggtatttcttccagaaccgcaggaggaaagaagtgccctcgcggtcggcgaacttggccaggtattcctggcgccgcgggtcgccgtcgtccttgagcaggttggcgctgttgctcgggccggcataggtgctgtagcgcaccaggtcgcgcatcaggcggatgaagggcaggttgatcgactcgcgcagggcgtcgcgcagggtcggcatgcggccgttgtcttccttgcggaagttatgaaaggtgtgcagcccgccgccggtgaaaaaactctcgccggggctggccgagtatttgcggtccagggccgcctcgagcattttcggcaggctgcggtagctgttctggatcaggtagtccacggcccagcggctcaggcggtcctgttcggcgatctcgactttcttcagtaccgctggggtttcggcgccgtactgctcgtacagttcggcaatgatctgcaggtaggtggtcaggacccgcagcttggcggtggagcccaactccagcttgctgccttcgttgatgtcgaagggctggtcggtgctgtcggtctggacccgcacccgcgaaccgtccggcgtcagttcgagcagggtgaagctgtagcgcacctgggtggtgctggtcggtgtcagcaggcgttcgccgagcaggccgatctcggcggcgaacaccgggtcggccaggtgcttgaggtactcggtggcctggcgttgcaggtcgctttgcagggtgctggtggcggacaggtcgaggcgatcgaggtcgtacagcggccggttgagcaagccggccaggcgactgcgggcgacgctgatgcctttgttggtttcgatcggctggatcgtcggttgctgcacccagtcgcggaaggtggccttgctggccagggcggcttcggacagtggcgtatcgatcacgccattctgggtcagcaggcggatatggctgtcggtgagttcggccagttcccggcggcccttggacaggtaatgcgaaggccggcgctgggcgatcatcaacgacagcacctggcgcagggccaggccgcgttgcgccaggctctgtggatcgctggcggtgctcgccagttgctcgttgacctgggtgaagtcggcgccgtaccagacccgcagcccttcggccatgccatgcacctcaccgtggccgggcacggccgacagcggcacgctgttgaggtagtcgcgaatgatgcgccgccgggcctcgagggtctgctggccgccctggtaggcacgcacgctggcggaaatcatctgccggatcttttccgcgccggacacggtcaggccgtccggcgagtgccggtacttttccagctgggtcgccagggtactgccgcccgccgtctgccctggcaagtgcaggagcttggccacttgcgaccaggcggccttggcgaagcgcggccagtccaccgccgggttggccaggggctggtcggggtcgagcaactcgcggttctcgatgaacagcaggctgcgcaccatcaccggtgggatggcggcaaagttcgaatagagctgttgcgggtacttgaattgatagagcggcgccgcgcggcaatcggtgatcgacagcccggcctgaatcttctcggtatagggtacgaagaagccgttttcgctgtagttcatcaaggcgggggagaagcgggtctgggcctccaccacgtaaccgcgcttgagcaggcgcgccagaaaatcatcgagggcgctgtagcccaggcgcttgtcgaagggcccggcgccggggtagacgatggcatcgctggggccgggcgccatggaatagctcaggtccgcggcgaacttgctgagctcgcgcgcctgcagtttcgaggtgcgcatttccttggacgcggcaaagcccagggcgaccagcgccatcagcagcaatagccagaacagccgccaccaaagccggcttgaatgggatttctcagggataggcgcttcttccacgcgatcagttggcactacttttttactcgaatcggtctgccacaaagcacccatagtcgactgatccattcacgcagattgatcggacttgtctgaagcttagacggtggtgggcaatggtgaaaaatttgtgcgcgacctgaaagcattcacctccccctgtaggagcgagcctgctcgcgacggtcgtcaacgatgattcggtgtatccgaagcattgcggcgccctcgggtttatcgcgagcaagctcgctcctgcagggcatggggcgaggcgaaagacgtttgagatagagctatcgcgaccggtaaataggtcctaggtaggggcatgacgctgcaccatggctgtgcaatactcggcgccgttcaaaaatgacaaacggcgaaaattccaggtaatgccacttcgcgaaaccggaaaataccgagatttctctctgaatttagctgtttatagagtgaaaaagcctgccgtcagctttttatactgcacgccccactgatcttgcaggatttgtcctacaagacgtgtcggcccacaaggtcgatccgatctggttggcacggattatccgtccgtgcctcacaggctcggtggctcatatccaataacaagatgaggttgtatccctatgccagttggcaaccacctgccccaaggcgagaccgctcaaggcggcccgctgaaacgcgaactcggcgaacggcatattcgcttgatggcgcttggcgcctgtatcggcgtcggcctgttcctcggttcggccaaggccatcgaaatggccggcccggccatcatgctgtcctacatcctcggcggcctggcgattctggtgatcatgcgcgccctcggcgagatggccgtgcataacccggtcgcgggttccttcagccgttacgcgcaagactacctcggcccgctggcgggctttctcaccggctggaactactggttcctgtggctggtgacctgcgttgcggaaatcaccgcggtggcggtgtacatgggcatctggttccccgacgtgccgcgctggatctgggccctggcggccctggtgagcatgggctcgatcaacctgatcgcggtcaaggccttcggtgagttcgagttctggttcgccctgatcaagatcgtcaccatcatcgccatggtcatcggtggcgtcggcatcatcgccttcggtttcggcaatgacggcgtggcgctgggcatctccaacctgtggacccacggcggtttcatgcccaacggcgtgaccggcgtgctgatgtccctgcagatggtgatgttcgcctacctgggcgtggagatgatcggcctcaccgccggtgaagcgcgtaacccgcagaagaccattcccaacgccattggctcggtgttctggcgcatcctgctgttctatgtgggcgcgctgttcgtgatcctgtcgatctacccgtggaacgaaatcggcacccagggcagcccgttcgtgatgaccttcgagcgcctgggcatcaagaccgccgccggcatcatcaacttcgtggtgatcaccgccgcgttgtcgtcctgcaacggtggcattttcagcaccgggcgcatgctctacagcctggcgcagaacggccaggccccggccggtttcgccaagacctcgaacaacggcgtgccgcgtcgcgcgctgctgctgtcgatcttcgccttgctgctgggcgtgttgctcaactacctggtgccggagaaagtgttcgtctgggtgacctccatcgccaccttcggtgcgatctggacctgggtgatgatcctcctggcccagctcaagttccgcaaaggcctgagcgcctcggaacgggccggcctgaagtaccgcatgtggctgtacccggtcagttcctacctggccctggcgttcctggtgctggtggtggggctgatggcctacttcccggacagccgcgtggcgctgtatgtggggccggcgttcctggtgctgctgacggcgttgttctacctgttcaagctgcaaccgaacaatgcccaacagggcgcggtgcgttcggcgtcgtaacgccatcaggcgattaaaaccaaaagcccccggtcagtgaccgggggcttttttatgcgggcgctgtttctgcggttccgggttttagtgttgcaaccgcccgttcaccgcagcccggtgaacggtcagctccccaacagccccgtggtgtccgcatcgaacgccgccttcgcttgttgcgcggcgggcgccagcagggccagcaacgcggcctcgctgtacagcttggtgctcgccaggtgcttgggcgttggttcgatcgggatcagcacatcttcatcgctggcgtgcagccagatcgccgcgacatgcagcgccgagacaaacaacacgcgcagttcaaaggtccggcctttgaggtgcggcgccttttccgccaggttcagcgcattgaccgtggccgacgccagggcgccgtggttcagggacgagaactcgacctggccggcgacttccgccagttgcgcatcggcaatcgagactccgtcgctgaacaccaggtaatgccagtcccccagcgtggcctgctgcaggcctttgccttgggccaggtcttccaggctcagcgagtagccgcggtagggctcggacaggctcactttgctggcggtggcctgggcgaactggcggttgacgccgaagcctttgctctgcagggccgcctggagagccgggcgcagtacctgagcgccgttggcgggtgccttgggataagtcagttgcatgctgccctccttagtttttccgggtgaagtaggtggtggtccagttgccgccgccgttgtacgaacgggggaaggtgttcagggcacgggtcgaatagccgtagatggaatccgcaatcagcaggtagctgccgttggtgccatagatcgccagaaagtgcgcgccgccgccaaaccaggcacagcgcaggccaacggggcgtcccatgttgatctggttgtcgatggccgacagttggatcgaaccctggctcatgccaccaaaactgcgggtggtttgcagggccgagtccaggtagccgtagacgttgcatggccccggctggttgcagcaggtattgcgccccagttgcgcgttggcgaccccgcattgagtccaggaaccggtgcggtaatagttgccgaccgaggccgacagcgcggcccagcaccagttggtctgggtttgctgctgaatgctgaagttgaggctggcggccagggcggcgtgttccgcgctgtcgtcgacttcgctcagtccggcgttgagcagggtgccgaccaggcactgtggcagtgcctcggcaggacctgtgcgggtaaagggtgtgtcttcaagggttaacattttcatcctccatgagtgaaaacaagcgtccagcttgcgtcgttgttgcgtgttgcgatgcagcgtttttcgcaagcccgtgaccggcctgtagggttcgccatcctcgatggcctgctccggtcgggctcaggggtaaccttagttgtgttatgcgtttgtgcaagtataaatatgcatttatgcaatttgttgtgggtaggtaatcaggccagaggaggcctgggagggggcttgcacgacagcggcccctgcaggccggcctggatgccacacgtctgaaagaccgccggatcagcgatttcgccaatcgatgggcagaaaaacctgccatacaagttgagcgatattcaacgggggagagtcacccatgagactcttatggaagggaatctccagatacacggtgatcggcatcgccaacacctttatccactggctggtgttctttttgctgagcctggtggctggcctcagccaggcgctcagcaacctggcggccttttgcgtcgcggcgtcgttttctttctatatgaatgcgcgcttcaccttcgccgccagggcctcggtcggtggctatctgctgtttctggggggcatgggggcgctgagcctgggtgtcgggcatgccggggatgtgtggcggctgcccggcttgctgacggtgctggtgttttccgccctgagcctggtggcgggttttctgttcgccaagttcctggtgttccgcgagtgtgaacgatgaagatctcgctgatcgttccggtcttcaatgaagagcaggccatcggcctgttttaccaggcggtgcgtcgcgagttgcggttcgagcagggcgaagtcgagatcgtgtttatcaacgacggcagttccgaccgcacggccgaggaggtcaaggccctggcgcagatggacgagcaggtgctgttgatcaacttttcgcgcaatttcggcaaggagccggcgttgttcgccgggctggagcacgccagcggcgatgcggtgattcccatggatgtcgacctgcaggacccgatcagcgtcatcccgcggctgatcgaggaatggcagaagggcgccgatgtggtcctcgccaaacgccgcaggcgcacggccgacagttttctcaggcgcagcagcgcggcgctgttctaccatctgctgaaccgtatcgcgtacacccggatcgaggaaaacgtcggcgacttccggctgatggatcgcaaggtggtcgatgtgatccggaccctgcccgagcaccagctgttcatgaagggcgtcctgtcgtgggccgggttcaccacggtggtggtggagtacgagcgcgccgaacgggtggcgggcaagagcaagttcaatggctggaaactgtggaacctggcgctggaaggcatcacctcgttcagcaccgtgccgctgcgcttgtggacctacatcggtggcggcatctcgattttcgcggtgctctacgcggtgtatatggtcctggacaagatcttcttcggcaacagcgtgcccggctacccttcgttgatgaccgccattctgtttctcggcggcgtgcagttgatcggcatcggcatcctcggcgagtacgtcggccgtatctatatcgaggccaagcatcggccgcgctacgtgatcaaggacgtcatcggcggcaaagaccgcctggggctctagcatggacagaatgggccgcttgctcagcggggaactcgggcgtcgccaggcctggctgttttttctgtgcgccaccttgttgtatgtgctgccgctgatcctcgcggactttccctatatcgatgacaactggcgctcgctgtcggccggcaccgcctggacggagcaggggcggctgtttaccgagctgttctacaacgccctgaccttcagcggcgctgcgccaaacatctttcccttgccgctgctgatcgccacggttgccatggccgcggccctgaccagcctgacgttccattactacccgcagccgacggcggcctgctgcctggtgctgttgccgctctggtacaacccgttctttctgcagaacctgtcgtatcaatacgacggcccggccatggccttgagcctggtggcggtgatctacgccatcacctaccgcaacccgtaccgcgtgctgcaatggctggtgccggccttgctggtcgcgctggccatcggcctgtatcagatcagcatcaatgtgttcctgggcctgtgttgcctggaggtgatccgcggcgccaatgacaagagcgcctggccgcgctggtgggaaatgatcggctggaaggtcgcccaggcggccttgggctggatgatttattgcgtcaccgcctaccccttcatggatcagacccgcaccttgctgctgaattggtcggcgcagcccttgctgcaactgcaagtcaacatcgccagggtgctggaaaaagtcgcgctgctgtttcacggcgggtttgcctgggtgttcgccgcgctggcgctgtgcgccctggccggttgcgtgcggttggcggcgaacctgttccagcggccggacagcggcctgaaaaaagtcgtgatggcgctggtctgcctgctggcattgccgctggtgtttgtgctggtgtcggggatcgcgctgtttttccgcgacttcaatgaaggcgcccggaccttgatgggcttcgcggtggtgtgggtgctgctgttctatctgagccacctggcgttggcggagctgcatgagcgcttgccgctgctgctgatggtgccgctgctggcgatgctgtcgctgtcgttcgcctatggccgggtgctgacggtgcagaaaaccctggtggccagcgcgctgtcgagccttgagcgcgacatcaccagccaccggccgttgcgtgaggccaagcgtatctatatgtcggtgacctattccgatcactggctgctggcggccgcgggctcgttcaaacagatgccggtgctgcactacctgctgaacatcgacttcttcatgctggccgagaacctgcccaaggtgggcattaccaacgtggtcgcggaaagggagcggcgcaatgcgaccctggtcggttacctgggctatccaccgctggtggacagccgctactaccggatctatctgctgggcgattacggttttatcgtcatgaaggaaccggcgccgatcaagacgttgcactggtgaggcactgggcttatccgctggatcagaactgatccatcagcagcacacggcattccctggcctggaaggcgttgatttggggcaccaggcgggtgaagtgctcggtctggcaatgggcctcgagcgctgcgcggtctggccattgctcgataaagatgaagtgcccagggtcttgctgatcgacgaacaggtcgtaggcgatacagtccggttcctggcgggttttctccaccagttcggcataccaggggcgcacggtgtcgaggtgttcgggcttgatgaaatcttcggcgatgactttgagcactggggctgcatcctttgcatgatggataacgccccaccggcacggtagagcgtcgagggtggccggtcaggccgcggcttcgctgttgggctcgaagctgtcggcgcgcgccagctgccacatgcgcgaatagaactcgccgctgaccgcgccggtgagcagttcgccgggcttgaggaacacatgcagctgcgagaacagcttgatctcggtggccgacatgcgccgtaccagatgcttggcttccagttgcgaggggtgctgcaggccggcggcggcgagcatttcggccagggccttgagggtgttgcggtggaagctgaacacccgttgcgccttgtccggcaccaccagcgcgcgctggcgcaggttgtcctgggtggcgacgccggtcgggcatttgttggtgtggcagctttgcgactggatgcagccgatggcgaacatgaagccgcgcgccgagttggcccagtcggcgccgatggccagcacactggcgatgtcgaaggcgctgacgatcttgccgctggcgccgagcttgatcttgtcgcgcaggttcaggcccaccagggtgttgtgcacgaacagcaggccttcgcgcattggcacgccgatgtggtcggtgaactccaccggtgccgcgccggtgccgccttccttgccgtcgaccacgatgaagtcggggaggatgccggtctccagcatggccttggcgatgcccatgaactcccacgggtggccgaggcagaacttgaagcctacgggcttgccgccggacagctcacgcagctgctggatgaaatgcatcatttcgatcggcgtggaaaaggcgctgtggctcgatggcgagatgcagtcctcgcccatgcggatgccgcgggtatcggcgatttcctgggtcaccttgtgcttgggcaggatgccgccgtggccgggcttggcgccctggctcatcttgatttcgatcatccgcacctgcgggtcctgcgcctgcacggcgaaacgctccgggtcgaaacggccgtcgctggtgcggcagccgaaataaccgctgcccagctcccaggtcaggtcgccgccgttttcccggtggtaagggctgatgctgccttcgccggtgtcatgggcgaagttgccgagcttggcgccctggttgagggcacggatggcgttggcgctgagggagccgaagctcatggccgagatgttgaacaccgaggccgaatagggctgcttgcactgcgggccgccgaccgtgacgcggaaggtgctcgggtcgctcaggggggccgggcgcatggaatggccgatgaattcgaaacccgactggtagacgtcgaccagggtgccgaacggcttgtcggcgctttcgttcttggcccgcgaataaaccagcgagcgctgggcccgggagaagggcagggcgtcgctgtcggactccagcaggtactggcggatttccgggcggatgccttccaccaggtagcggatattaccgaggatcgggtagttgcggcgcaccgcgtgggggctttgcagcaggtcgaaaatgcccagcaggctgagcaggaaggtgaccagggtgattggccagagccagtcatgttcgagaaagggcaagctggcgagggtgaaaatcacgcaggcagcaaagaaggcgtagcggctcaggagggacaggctcatacggtttccttggttcggactctatagatttcgtttttgggtactcattcttcttgtgtggccaacgatcttgttgttgtagagaacggctgtggcgcagccagtgtgcgcacatggcagcttcaggcgtcaggcagtgcgcgcctggagaaaaatcgaaaacagttcggaccgggacttgatgccccgcttgccgtagatgtgtttcttatggacgttcacggtttcggcaaaggtttgcagcttacgagcgatctccttgttggagcaaccgctgagcctcaggtgtccgccctggtgccaggcgttgacgagggcgatagacgatttgctgctttccttattgcaactggttctcgtttccatggttggataatgttactgtataacgcattcgatcatcaccctgccctcggagactgccatgaaagccaatatccatcccgcctaccgcaccgtactgttccacgacaccgccgcggatgtgtacttcctgatcggttccaccgtggataccgatcgcacccagcgccacagcgatggcaacacctatccctatgtcaccctcgacgtctccagcgcctcgcatccggtctacaccggccagcagcgcaagacccagtccgaagggcggatcgccggcttcaacaagcgtttcgcttcgttcggttcgtccggcaagaccggcaacgcttgagggccccggcccttgccgtacagccgctcgttcctgcacccctgtaggagcgggcggcatcctctcgtccattcccctctctaatgacggccccccatggaaggcctgaacggcgtcgcttcgtcccgccggccgaggcgctgggtgtatggaaaaaacagcggccgactgtgtcgtgacgacgactcgccagtcatgggatccttgccgcctcgcgtaaccgatccaggtttttcatgactctttcaagcgctacatccccccttatccgtatcgccgcggccctgctgatcggccccgacggccgtaccctgctggtgcgcaagcgcggcaccctggccttcatgcagccgggcggcaagatcgagccgaacgagttgccggcccaggccctggcccgtgagctggaagaagaactcgggctgcgtatcgccccggtcgacgcccgttacctgggccgtttttccgcaccggcggccaacgagccgggttttgtggtcgaggccgaattgtttcgcctcgacctggacacccacgaggtccggcccgcggcggaaatcgaggaggtctgctggatcgatccgcaggctggcgacgagctcacattggccccattgacacgcgacctgatcttgccgttctatcgcgcctcgcaactggcctcggcctgatttttcaaggacaaaggattgcccatcatgattccccttcacgacatgttgatcttcatcgccgcagccttgctgatggtgctgacccccggccccaacatgatctacctgatctcccgttcgatctgccaggggcgccgggcaggcgtgacctcgctggtcggcgtggtggccggcttcttcgtccacctgttcgccgcggcgatcggcctgaccgcggtcttcatggcggtgccggtggcctatgaagtgctcaagtgggtcggcgccctgtacctgatgtggctggcctggcaggccctgaagccgggcgcgcgttcgccgttcgaggcgcagcagttgccgccggattcgtcgcgcaagctgatcctgatgggctttctcaccagcgccctgaacccgaagatcgcggtgttctacctgtcggtctttccccagttcatcagcccggaacacggttcggtgttcacccagagcatcatcctcggcctgacccagatcagcgtgagcttcagcgtcaacctgctgattgcgctgttcgcttcgggcatcgccgcctggttcgtgcacaacccgctgtggctggcgacccaacgttatttcatgggcttcgtgctggccgggctggcggtgcgtctgctgctggaacaacgccagacggtctgaccgtttcattcacctgcggcccgggggcctcgaccgaccatgtccatccagcgcctcgatgccggtcacgccgttgcctaccgcgcgctgatgctcgaagcctacgagcatcatccgcaggcctttacttccagtgtcgccgaacgtgcggcgatgcccttgagttggtgggagtcgcggctgagtagcccgctggacctgttgctgggggctttcgagggtggcgaactgatgggcatcgtcggcctggcgttcgaggtccgggaaaaagcccggcacaaggccacgctgttcggcctgtatgtggcgccgccttatcgccacggcggcctgggttaccggctggtccaggcgctgctgcaggaggcgcgcgaacgccccggggtgcggctggtgcaactgacggtcaccgccggcaacgacgccgccctggcgctgtaccagcgttgcggtttcgtccagttcggcctggagccgctggcggtacgggtgggcgtcgagtacttcgacaagcttcacctgtggcgtgaagttgtctcccccctctgaaagtccccgttcctgcaggccgaataccgcttttcaacgcaccgcgctgaccccgtccagggtcgagaacgaggtgtccttggcggtcagcaggaagtcgcgcatatagggcgcatccagcatgtcggcgcggatcgccgcgtacagcgtggcgaacaggcctttttcccccaggcgcttggccttcacatagccccgcgagctgtattcatgcagcgcccagtggggcatgccgcacacgccacggccgctggccaccagctgcatcatcatcaccgtcagctccgaggtgcggacctgggccggttcgatgtcggcgggctccaggaagcgggtgaagatatccaggcgatcgcgttccaccgggtaggtgatcagggtttcgctgagcaggtcttccggaacgatgtagggtttgctggccaggcggtgctggttggccaccgccagcatggcttcgtaggtgaacagcggcacgtaggtgatgcccgccagctccagcgggtcggaggtcaccaccaggtccaggtcgccacgggccagggccggcagcggggcgaaggagaaacccgaggccaggtccagctcgacttccggccaggcgtcgcggaactggtcgatggtcggcatcagccactggaagcagctgtggcattcgatggccatgtgcaggcgcccggcggtaccgccggccaggcgggaaatgtcccgctcggcggcgcgcagcaacggcagggtggcgtccgccagttgcagcaggcgcaggccggcgctggtgaagcgcaccggcttggtcttgcgcacgaacagtggcatgcccatgcgctcttccagttccttgaactggtgggacagggcggactgggtcaggtgcaggcgttcggcggcttcgaccaggctgtcggcttcgcgcagggcatgcaaggtcttcaggtgacggatttcgagcaccagggtctccatgagtaaactttgtgatcaacacgaaaaggttgagtttgtctcatgttgggttggctgtcgacaatagcgccatcttttaccgggaggaacccactcatggccttggcccacacccttggttttccgcgcatcggcgccgaccgcgaattgaaaaaagccctcgaatcctactggaagggcgacctcgaccggcaggcgctgcaagacgtcggacgccaactgcgggccaggcactggcagctgcaaaaggacgccggcatcgacctgctgccggtgggcgacttcgcctggtacgaccaggtgctgactcactcgctgaccttcggcgtggttcccgagcgcttcgacagcagccaggacgcccagggccggccgaccctcgacaccctgttcgccatggcccgcggtgcctcgactggctgctgtggcggcgatcacgccaagacccagtacgcccaggaactgaccaagtggttcgacaccaactaccactacctggtcccggaattcagcgccggtcagtcgttcaagctgagctgggagcagctgttcgacgaggtcgacgaagctcacgccctggggcaccgggtcaagccggtgatcatcggcccgctgacctacctgtggctgggcaaggccaagggcaacgatttcaacaagctcgagctgctggagcgcctgctgccggtctacggcgaaatcctcaaccgcctcaaggcccagggcgtggagtgggtgcagatcgacgaaccgatcctgaccctcgacctgccgcaggactggaagagcgccttcgagcgggcctaccacatcctccagtactcaccgctgaaaaagctggtggccacctacttcagcggcctgcaggacaacctcgggctggccgtcggcttgccggtggacggtctgcacatcgacgccgtgcgggcgccggagcaactgacccaggtgctcgaccgcctgccgacctacaagattctgtccgtgggcctggtcaacggtcgcaacgtctggcgttgcgagctggagcaggcgctggcgcagctgcaagcggcgcaggaacgttttggcgacaacctgtgggtcagcagttcctgctccctgttgcacagcccggtggacttgtcccgggaagaccagctggatgccgagctgaaaagctggctggcctttgccgtgcagaaatgcggcgagatctcggtgctacgtgacgccctgaacgatccccaggccccggcggtgcaagcggccctggccgcaagccgccaggtgcaggccagccgcgcgcagtcgccgcgcatccacaaggccgaggtccaggcgcggctcaaggcggtcagcgccgccgacagccagcgtcattcgccctttgcccagcgcattgcccggcagcatgcccgcttgaagctgccggtgttcccgaccaccaccatcggttcgttcccgcagaccgcctcgatccgcctggcccgccaggcgttcaagcagggcaagctcgtcgaacaacgactacaccgatgccatgcgctgtgaaatccgccatgcggtgcaggtccaggagcgcctggggctggacgtgctggtgcacggcgaggccgaacgcaacgacatggtcgagtacttcgccgagcaactggacggctacctgttcacccgcttcggctgggtgcagagctacggttcgcgctgcgtgaaaccggcggtgatctacggcgacctgagccgtccgcaggccatgaccgttgactggatcagctacgcccagagcctgaccgacaaggtgatgaagggcatgctcaccgggccggtgaccatgctgatgtggtccttcccccgcgaggacgtgccgcgtgaagtgcaggcgcggcaactggcgctggccctgcgcgatgaggtggtggacctggaaaaggccgggatcaagatcgtgcagatcgacgaggcggcgttccgcgagggcctgccgctgcgccgggcggactggcagccgtacctggactgggcggtggaagccttccgcctgaccgcctctggggtgcgcgacgatacccagatccacacccacatgtgctacagcgagttcaacgacgtgatccaagccatcgcggccatggatgccgacgtgatcaccatcgagacgtcgcgttcggacatggagttgctggaggcgttcgaagccttcgactacccgaacgacatcggcccgggggtatacgacatccactcgccgcgagtgccggacactgccgagatggtcaagctgatgagcaaggcggcccggcgcatccccgccgagcgcttgtgggtcaaccccgactgcggcctgaagacccgcgcctggccggaaaccgaagccgccctggtcaacatggtcgccgccgcccgtcagctgcgtaaccagcaggcctgagcacccccagcccctgtagccgctgccgcaggctgcgataaggcccgaagggccttcagcgaactcaagatcgctacgtcccttcgggccgatcgcagcctgcggcagcggctacagggttttatgaccgctgggcaatcttcatcaaactgtcacgtaactgtggcagcgcgctcgatcaaagttcatcagactcgcgctctactgggcttctgcgtttcggtgtttcttcatgtgggcaagatttttttcaacgactgttttcctggccgcgctgttgctcggcctgccgtctcaggcggcgtctcgctgcgatgtcaacgtaccgacccaaagggtcgaactggagcaggtgagcctggcctaccagagcatcggccgtgcctccgatccggccctgctgctggtgatgggcctgggcgggcagctgatccactggccggacgaagtggttgttgccctgtgccagcagggttttcgggtgatccgttacgacaaccgcgacgtcggcctgtccacctggcgccaggcgccggtcagcgccaacctgacgttcgaggtgctgcgctacaagctcggcctgccggtggccgcgccctacagcctgaccgacatggccgacgatgccctgggcctgatgaatgccctgcaggtcgagcagttccatgtcctgggcgcgagcatgggcgggatgatcgcccagcacctggcggccatggcgccgcagcgggtcgagagcctgaccctgatcatgaccagctccggcgccgaaggcctgccggcgcccaatgcggcgctggtgcaactgttgtcgcgacgcggcgcgccgaaccgtgaggtggcgctggagcaacaggccgacctgctggccgccctcggcagcccgcaggtcaccgacgatcggcaggcgctgctgcatcaggcggcggaggcctatgaccgggccttcaacccggaaggggtgaagcgccagatcatggcgatcctcgccgaaccgagccgggtggccctgctcaatcagctgcgcgtgccgaccctggtggtgcatggcaccgccgatccgttgctgccggtgatgcacggcgtgcacctggcggcgcatatccagggcagccaattgaagctgattccgggcctggcccatcgtttccaggaagccttcaaggcgccgttgctggcggcggtgctgccgtacctgcaacgccatcgcgaagacacttcgcactgggcgcagatcgatccgctgcctgcgccgaatctcctgtaagtcgattcctgttgtaggagcgagcttgctcgcgatgaacccacaggcgccgcgttgcttcagaagcactgcgtcatcgttgacgaccatcgcgagcaagctgcgctcctacagaagcggacggtgctctggcttctgtaggcgccaggcttgccagcgtcgagcagatgggtgcgcttcagcgaacgatcttgtcgacctggatcccgagctttttcaggcggtaccagaagctgcgttcggaaatgccgatcagctgcgcggcggcggcttgcacgccgttgctctgttgcagggcggcgaggatgtaggccttctccacttcggccagggccgcgtccaggtcgctgggcacgctgaggctgtcggcgggcagggtgcaggctccggcgttcattggcggtgagctgaacagataacccggcaggtcgctttcttcgatcaccgcgcccgcggcgactatggtcgcgcgctcgacgcagttctgcagttcgcggatattgcccggccaggcgtaattggccatcgcctgcagggcctgtgggctgaagccggtgatgcgtttgccggcggtggcgcccagggtatgggcgaagtgccgggccaggggcgcgatatcctcgacccgctcgcgcagggcgggcagggggatcgggaagacattgaggcggtaatacaggtcttcgcgaaactccttgttggccaccgcttccagcaggttcttgttggtggcggcgatcacccgcacatcgaccttgcgctcgcgcgggtcgcccaccggttcaatcactcgttcctgcaaggcgcgcaggatcttcgcttgcagggccaggggcatgtcgccgacctcatcgaggaacagcgtgcccttgtccgcctgctgaaagcgcccgacccggtcggccacggcgccggtaaaggcgcccttgcgatggccgaacatttcgctttccagcaggccttcggggatcgccgcgcagttgaccgcgacaaagggtttgttggcgcggttgccgtgctggtggatggcccgggcgaccatctccttgccggtgccgctttcgccggtcagcaggatggtggcgttgctttcgcgcaccgagtccaccgcttgcaggacccggcggaaggtcgggctgtcgcccaccaggctgtcgatctgccggtgctcgtcgagctcggcgcgcatgcgctggttgtctttgaggatgtcgcgaaactgcagggccttgctgacggtgatgtccagctcgtcgatgtcgaagggcttggcgatgtagtcgtaggcgccgttgcgcatcgactgcacggcgtttttcaccgtgctgtaggcggtcatgacgatcaccgggatctgcgggtagcgttgcttgatctcggccagcagctgcgggccgtccatgccgggcatgcgccagtcgctgatcaccaggtcgatctcttcctgctccagcaccttgagcgcatgcaggccgttgccggcggtgaacacctggatgccgtcctggctcagcgccgaggacagcaggtcgcaaagcttgggctcgtcgtcgaccaccagcaggttatgcgtcatggctgggccttttgctcgtcttgatcatcttcgtcgtcctcacctttggccggaatgtacaggctgaaggtggcgccggcatctatttcgctgctgcattcgatgcgcccatcatggttttccatgatcgagaacaccttggccaggcccagcccggtgcccgaggccttggtggtgacgaagggggtgaagatgcgttcgagcatgtccggctcgatgccctggccggtgtcggcgacccgcaggatggtgtgctcggcgtcctgggcgatgcccagggtcaggcgtccgccggcgggcatggcgtcgatggcgttgaggatcaggttcaggcaggcctgcttgagctggcgggcgtcggcgtacagggtcgcgcccggcgcctggtcgtcgatttgcgcgtcgatcttgtggctggccagttccggctcgcagaagccgatcagttcctccaccagcggccgcgccagcagggtcgagcggatcggcgcgctgggtttggcgaagtcgaggaagtcggtgatcaggtcgttgatccggctgacttcgctgatcacgtattccaggtggcgcttgtcgccttcgggcaggtccgcacggcggtgcagcaactgggtggcggtcttgatgatgcccaaagggttgcggatttcgtgggccaggcccatggccacttcgccgagggcgtgcaggcggtcgcggcggcgcaactgggcttccaggtgctgcagttcgcccaggcgttcgctcatatggttgaaggtgctgctcagctccgccagttcgtcgccgccaatcaccggcacgcgttgccggtagtcgccggcgatcaccgcctggacccccttggacaagccgcgcaggggcatggtcaggcgtttcgacaccagccagccgacggccagcgacgccgccgagctgagcaggaagatcaggatgaacaggttgctctggttgaccagccccaccaggctgctgtggcgcagcaggccgctgaaaatcacccccaccagctcgccgctgtcgttgaagatcggccggtacagcccgctgtagcggctggtgaactgctccgtgggctggcgagtgtcgcgcaggatgttctcgatcttttccggcacctgggtcgggtggtcctcgaagcgctgggtggcgaagatctcggcgaagtcgttggccttggccaggtacaggcgcaggtcgagggagtgtacgtcggctacgctggtgaggaagctggcgtccaggtaggtggcgatcagcagctggtagtcgatgccgtcgagggtggtctggaaggtcgagaccaccgctcccgtggccacgccgccgacctgcagggtctgcagcacggcgttgtgggccaggctgacctgcccgacgatgtcgtcggcggcggtgctgaacaccacctgctggtcgcgcttgcggatcagcgccaccacatcgatgcccatggagtcggcgatgtcggcggtgagcttgtcgtgcctggccgcgttgcggtcggtgggcggcttggcatagcgcaggaacagctgggcgatgcgcgcgttgtcgcgcagggtctcggtgatttcgtcctcgacgatcttggtcgactcctgcagccagatgcgcacgttgctgtcgaagatctgcgacagggtagtggccgccagctccgcggcgatcatggtggggatcacgctgaccatccagaacgccagcaccagcttgcgctgcaggctccagcgggagatggcgaaagggcgaggggcgcggcggtcttttctggtcatgaactttcgcttagtgcagcagccatggcggggtcggtgcgatccggccggagaacatatttcagccctttgagcagggtgtcgagcagcgggttgcgatgctggaaaaacaggctgttgccggtgaaggtacagcccaggcgcagcttgctggcataaccggcctggccacattcgtagagcgcgatccggtgctggatacagtagtcgacattggccatccagctgcgcaaatacaggttgtgctcacgactgatatccaggtcgtgggcgaagaatttgtcgatcagccggtgctcgtccagcagcaccaggttgaaggccaccagttggtcgtcgacccagtacagcacgcaggcggcccgttcccccaactgctggaggataccggtgaaatagggcgcgggtaagcgttcgaattgcagttcgctgcgccgcagggtggcttcgtaaaggcgcatgacttcgggcagcacgtcgtcgatgttgtgtcgccattcggttcgcagcccgggcgcgcgcaacttgcggcgcaggtccttgcgcgtggacttgcccagggtgccgaggtaggcatccagcgagccgaagggcaccggcagcagggcgctgggcaggctgggcatggcttgcaagccaaacgcctggcagctggcggcccattgccgatcctggctggcggcatccttgaccgccagcaggccgatgccctgggcgtcggcgtcgcgccgggccaggtgcagcagttgctccagcagggcctggcggcgcaccgcggggatatggctggcggtgccggcgtggcactgttcagccaccggcgaaccgatggcgtacaggcgcagttgcagcagcccaggccaccagcgttgcaggcgttcgctcaggtgcttggccgggcccgagacggtggtgtccaggcgatagcaggtggtgaaggccggggcgacggccaccagcttcgaatcttcgaacaccgccaggtagcgccagctgaagccctcgatgccggcgttctgtaccgccaggtaataatcccaatcttccagggcgccgggaaaacagtcgttccaggcgttgcggtcgatggcctggatgctcgaaaagacttggctggtgatcacgtgcggtccttgaatcaggcgaactggcgcaggtcgtcgtacgccacgggccgcgggcctgcctgcctttcgatgaagtccgcgctcaactccaccacccggcggtactgcaggtcgacggtgatcatgtggtagcagttgtcgagcagcaccttgaccaccgggccgccgagcttgcgttcgacatagtcggcgttccagcggctggtgatgtcgtcctcgatggagtgcagcaccagggccggggtggtgatcgacggcatgcgttttttcaccaccgcgttcatccggtgcagttcgcgcacggtcaccccttccatggtcagcaggccggcactgctgctttcgccggccttcatctgccgctcgaccaccgcccgcaggcgcttgttcttgatgccgtacggcggcttctcctcgaagctgcagatgtgcacgccgaacggaatcttcatcagcagcggggtgaggaacgccagcttgttgatgctccagccgtcgtacttgagagtggtcgaatacatcagcaggccgctgacctggcccgggtgttccgaggccaggtacatggacatgacggcgcccatcgacaggccgccgacgaacacctggcggtggcggcgacggatgccgacgaaggtccggcgcacgccctcgtaccagtcctgccagccggtggcctgcaggtcggcgttgttgccgcagtgcccggccagggtcggcacgtacaccgtgcaccccgcgttggccaggccgacggccacccgacgcagttctgtcggggtgccggtgaggccgtggatcagcaataccgcgacctcgccactgccgagcacgaacccggcatcgccctggcccaggtcgatgccttcgtccagatcgatcagtgcgctcatcgcttcatggcccggtccagcagacggtcgagcagggcgatgccgaggtcgatctccgcgtagctgatttccagcgagggggccagggtgatgacgttcttgtagtagccgcccacatcgagaatcagccccaggcgctggccattgatttcgatgtcgcccttcatgccttcctcgaccatgtagtccagggtcgccttgtccggggtgaaaccgtcggtggcgcagatctcgcagcgcagcgccaggcccaggccgtcgacgtcgccgatgatcgggtagcgcttctgcaggtcttgcaatccggccaggaagtacttgcccttctccatgaccatcgcgccgtagtcgatctcgctggtcatcttgaacatctccaggcccaccgcggtgcccagcgggttggaggcgaaggtcgagtgggtcgaacccggcgggaacaccttggggttgatcagctcttcgcgggcccagatgccgcccagggggttgaggccgttggtcagggccttgccgaagacgatcacgtccggcttgacgtcgaagtgctcgatcgaccacagcttgccggtgcggtagaagcccatctggatttcgtcgaccaccatcaggatgccgtgctggtcgagcacgtgcttgagctcgctgtagaagttcatcggcgggatcacgtagccgccggtgccctggatcggctcgacgtagaaggcggcgtattcgctctggccgactttcgggtcccacacgccgttgtattcggtctcgaacagccgggcgaactgctgcacgcagtggctgccgtactcttccttggtcatgcccttggggccgcggaagtggtaggggaagggaatgaagttggcgcgctcgccgaagtggccgtagcggcgacggtagcggtagctggaggtgatcgacgaagcgccgagggtacggccgtggtagccgccttcgaaggcgaacatcaggctcttgccgttggtggcgttacgcacgactttcagcgagtcctcgatggactgcgagccgccgacgttgaagtgcacgcggccgtcgaggccgaatttcttcttggcatcgaccgcgatcatttccgagagctcgatcttgcccttgtgcaggtactggctggcgatctgcggcaggctgtcgatctgttgcttgagggcgttgttcaggcgtgggttggcatagccgaagttcaccgccgagtaccacatctgcaggtcgaggtaggcctggtcgctggtgtcccacacgtaggagccttcgcagcggctgaagatccgtggcggttcgatgtagtggacggtgtcgccgtaggagcagtacttggcttctttttccagaagcacctggtcttcggcggtcgcgatacgaatgtcagacatggtggaagagttcctgagtgggtacgcaatgttcggtggtgttgtcgagggtgaaggtgccggcgttggccgcttcgttgggcaacagcgccagcagtgccggcagttcggcgaaggaatcgaaagtcgcgtggggaatggcgttgcgttggcaatactcggccaggcggcccttggcgaacacgaagtcggcgctggcggccacgcacatgtcggactggccgtcgccgatcaccagcacccgcttgcccttgggcgtggatttgcatttgcagttgccggacgcggcgcggcaggcgtcgctggaatgcgggaagtcgatgcgccagctgtgctggtcgacctggcgcagacggttggcgaggatcggcagcaggctcacgtagtggcgcgcgaggatgcgcgcgatgccttgctcgatgccgtcgctgaccacttccagggacgcgcccaggccgatcacgtgatcgacgaagtcggggaagtcgggatcgatctcgacgctgtcgaagtaggccagcaattcggcgggcgaggccttgaccagcgccagttggcggctgaggcattcccgggagccgatatggccgtccacccattgctgctcgatgtcttcccagctcgggtcggcgaagcgttggaggacgttgtcgatcacgtcggtgcgggtgatggtcccgtcgaagtcacacacgatatgccagtgcatcatctgcagttacctgttgtagaggagcgcactttgcgcatgccaggcactggagcagggactgtgccaagtggctcaagcccaggcaggccgggctttgcgcgggaacaaggcgttggatgggcgggttggagctacaaattttgtagctcgctacaaacaacatcagtgcttgcggggagggggcagggtggtgattgatgcgcgcatcttcacttaaggaaccctgcgccatgttcagcttcacacgctccgccctgctcgccgccgtgctgtctctgggggctgtctgcggggctttcgccgaggacggaggccaggatggattgagcggcgcgctgggcctgggcatcggttaccagccccatgaccccagcggcagccggcatgacaccgtgcctttgccctatgtcgatctggagtggggcgatgtcagcctcgataccgacgacggcctgacctgggacgccttcaaggccaagggtttcagcgccgggccctatatcaactacctgccgggacgcaacgccaacggctcgctgcgcggcctgcgggatgtgccgaacatggccgatgtcggcggctacatccagtacgcgccggacgacttctggcgcctgttcgcctccctcggcagcgcagtggccgcgggcgagggccagggcggcctgctgggcaaggtcggcggcgaaatcggttatcccctgggcctggggatcatcggcagcagcaacctcaccgcgcatttcgccgatgcccggcaaacccagaccttctttggcatcagcgacgccgaggcccaggccacgggcattggccgctacagcgccggtggcggtttgcagaacctgaccctgacccagaacctgcaggtgcccctgggcggcaactggtcgtggatgagcagcgccagctggattcacctgacgggttcggcggccgacagcaccctggtgcgcgagcgtggcgaagtgaaccagggccaggtccagaccgccctcagctaccagttctgaggccggccaaggccttatcgccgggcttgcggggcgttctccaggccatcatcgcgggcaagcctcgcccctacaaaagcggggctgaacagctctgccggcatgcgctgtttctgtaggagcgagcttgctcgcgatgcaggcgtagcctgccttttgtgctgtatttctctccggttatctggatgatctcgggggttttcgcgagcaagctcgctcctacagggagagcctgtgtcattgctgtcgcgaaccgtttcgttattacgtctgagaaattggtccaccctttgcactggcagccatgaacccatttttcaggaagttcttcatggctcgtcccgcttatcgcctgcttgcccattcgctgtgggaccttgtcccgatcctgatggccctggcgcatttttccttcgtcctgtggctggtgctggcctttcacagcctgtcctggtgggtgatcctgccagcggcgctgctgtatgcgctcagcctgtcgtggagcatcaacagcatttcccacaaccagatccacaacgcctatttcagcctgccgtggctgaaccgcggcttcgatctgctgctgtcggtgaccatcggtttttcccagaccctgtaccgcgatatccacaaccgccatcaccgtggcaactcggatcggcccgggccggacggcaccacggtcgatccgctgtcgatctacctgcatggccgcaacggccagccggacaatgtctgggcctacaccttcctgagttttttccgcgacgaccccaaggccatctaccaggaaatgcagcgcaagcgcccggcggacgcgcgttgggtcaaggtggaaatcggcgtgacggtattggcctacgtggcgctggcgctatacgactggcatgcgctgctggtgctgctgccgttctggtacctgggacagtcgctgtcctcgctcaacggctactacgaacacctgggcggcaacccggacctgccgatcgcctggggcgtgagctcctacagctggctttacaacctgatctggatgaacaacggctaccacgccgaacaccactaccggccgaagatgcactggacccgggtcaaggccttccaccgggagatccgcgagcagcagcgggcggcgggggtgaaggtgattccgctggcccatggcctgggctttctgctgaaacaccccaagcgctgacacccgcgcacctgtagccgctgccgcaggctgcgatcgaccggtacagtcgcggcgttctgaagaccgcgaaaggttctgcgggagattgggaaccaaggccctgcgggccttatcgcagcctcgcgggctcggcagcggctacaggggcgttatgtgccccatatcctaggcttcctcgccctcggccagcagggcgatcccgccgacaatcaccagcacgccgacccagtgcagcaggctgatctgctcgcccaggcccagccaggagccgagcaacaccaccacgaacaccagcgaactcagggggaaggccagcgacaggctgctgcgccgcaggatcagcatccacacgaagaacgcgccgatgtagcaggcaatcgccagcagcacccccgggttgaccgccaccgcggccagccattgcaggttgaaatccatctggcccagttggtcgccgccgaccttggtggcgatctggccggcgctttcgaagccgatcagcagggcccagagcaccagggtgccgaggcgcccgtggagccagccgtgagtctgtgcagtcatgaaatctttccttgtgaagcgttgagggggctcaggtgctggcgacgcacaccagcatcacgccgagggtgatgaccagggtgcccagccagcgccgacggctgacgtgctcgccgagaatcagcttgccggccaggaccacgccgcaataggccagggccgccgccggaaacagcaggctcagcggtgcgcgggacagggcttcgagccagacgaaaaactcgatcacataggcgccgatgccgcaccacaacagcggcgcgttgaacacctggccccagaaggcattcaggcgaaaaccgccttccagctccggcaaacggtccaggccgagcttgaaacagagctggccgattacgtccaggacaatggaaaaggccaccagcaagacgacggtcagggtcacgggaacagctcctcgaacagcgccatcagggcttcgttggtggtcgaattgcgcagcaggtcggccgcgctccagcgttcggccggcggttggtcggagcgtgcttcccagcgcttgaaggcgttgctgaaggccggcgtggcgaactcgccgcagatgtcgataccgaggatgcgcttgctcgccgccaggctgcgcagggcctgcagcaggtggctcaggcgcatgccgccctggtcccagttggtcgcggcgtcggcgctggccagcacgtccttgtcgatggtgatccagatcgcctgggtcggcaggctggcgatcaactggtcgaggaaggctggccagtcgagcccggccaggttgcgccagtgcaggtggttttcctgctgctggtgcccggcgccgtcaccgacccggccccagaccttggagggcgcgtgctcccagggaaacagctgcagcttgccgtggcgcagcgcgccgaggttgccgccgcgcagttgcgggttgtgcaggtcgtcgctgcatggcccgagggtgacgatgcgctggatgtgcggcagttgcagcgcccggttgacccaggaaccgcagtgccggcgcggcgcgaagcgcacccagtcggggtggttgtcgaagtggatcaggctgaccggctgttgcaggtcggcgaggaaggccggggtcaggtggtgatagtcaccggagccgacaaagaagatttccggctgcgggccgctgtgggcgggcctttgccgcaggcgctcggtgaagtggcggtaggtgcgttcggtggaccagagccgcagtttcgggcccaggtccagcaggtccaggcgtcgcgcctggccgctgcgcagccggcgttggacaggctcctgggcggtcaggctgtggtcgagatcgagaatgttcaaagcaggatttacccatggcagcgcccctcggaaaagcctgcgtcacaggtcgtggacgcaggcagagcgggctttacagggtaaatgcaagggacgggccagggcgctgagcggcacctgtagccgctgccgggcccgcgaggctgcgatcgcccccgcagaggtcttgagatcgctgaaggccttcggccttatcgtccgaacgcggcccgagtctgcggcagcggctacaggagcgcgaggggagtcaggcgtggacgcggacccagacgctgaccagcacggtggcggccatcagccaggccaccgcggccaccgccagggaggcttccaggcgcaggcggtcgaccatcacgtagagggtcgccaggtacacgaagtagggaatgatcgaccacatgccgaacacgattgtggtcttcaggtcgtcgatggaacggcccttgccgacgatgtagtgggcgatcagggcgaaggtcgggaacagcggcaccaggccggcgatgtagtaattccgggtcttggccagggcggcgaggatcaccaccacggcggcgcccaggcaggctttgagcaataaatccacggtacttctcgcagtctggttagtggctcaggccgtatttcttgaccttgtcgaacagcgtggtcttggccatgcccagttcctggctggcctgggtcaggttgccgccgctgcgttgcagggcgtcgttgagtaggttgcgctcgaaggcctcgaccgcttcggcaaagcccaggccctgcgcggcgttgccgctggatttcttgaacgccggcaggcccagggcaaaacgttcggcgacgttgcgcaactcgcgcacgttgcctggccagtcatggctcatcaggttcgacagagtctggttgtccagctccggcgcggcgcggtcgaagcgcagggacgactgctgcaggaagtgttcgaacagctgcaggatgtcctcgcgccgttcgcgcagcggcggcagctccagggtcaccacgttcaggcggtaatacaggtcgctgcggaactggttggcgcgccccagttcgtcgagatcggacttggtcgccgcgatcacccggcaatccaccgccacgctctggttcgaaccgaggcgctccagggtgcgctcctgcaatacccgcagcagtttgatctgcaggttcatcggcatgctttccacttcgtcgaggaacagcgtgccttcgtgggcgtgctcgattttgccgatacgccgcttgccggcgccggtgaaggcgttggcctcgtggccgaagatctcgctttcgaacaggttttccggcaggccgccgcagttgagggcgacgaactggtgggtgtggcggcggctgaaatcatgcaggcagcgggcgaccagttccttgccggtgccggtctcgccttcgatcagcacgttggccgaggtgtcggcgacgttggcgatcagctcccgcaggtgctgcatggccggcgaacggccgatgatccgtccttcgagggagtcgcgctcggccagctggcggcgcagcgacgacacttcccgggccagcccgcgctgctccagggcgcggcgggcgacatccaccaggcgctcgggggagaagggcttttccatgaagtcataggcgcctttctgcatcgcgccgacggccatggagatatcgccgtggccggtgatcagcaccaccggcaggctgcggtcgcgggccttgaggcgggtcagcagttccaggccgtcgatgcccggcaggcggatatcgctgatgacgatcccggcgaagttgtcgccgacccgctccagggcttcttcggcgctgccgacgccgacgcagggaatgtcttccagggccagggcctgctggcagccgagcaggacatggggatcgtcttcgacgatcaggacggtaaggtcgttgttcatagcggctcggcttgtgtagggctgaccaggggcaggctgaggacgaaggcggtaccgccgtcggccgggtgctcgacgcccaggttgccacccgtggcggcggccaggctggcggacagggtcaggccgaggcccaggccctgttcgccgggtttggtggtgaagaagggttcgaacagatgcttgcgcgcctcggcgtcgatgccatggccgttgtcgcgcacccgcaggcggtatttgccttcgatgctttcgccttccagccacagctccggccgcggctgggtctgcatggcgtccagggcgttgccgatcaggttgaccaggatctgctccaggcgggtctggtcgatccttacctggacttcgctgaagtcgcggtgcaattgcagcggcaggttttccaggcgtgcgttgagcagttgcagggcggcgtccacggccttgccgaggctggcctcgccctggtcctcgccacgacgggcgaaggaacgcaggctggcggtgatgcggcccatgcggtcgatcagttcgttgatggtcttgaggttggtgctggcggtgtccagggcgccgcgttcgaggaaacgcacggtgttgccggacagggtgcgcagggcggccagcggctggttcagttcatgggcgatgctggtggacatctggccgatagcggcgagcttgccggcctggaccagttcgtcctgggcgcggcgcagggtttcctcggcctggcggcgttcgcggatctggcccttgagccgttcgttgctggcgcgcaggtcgctggtgcgttcggcgatccgccgttccagctggttgttggcttcctgcagggcttcgcgggcggcgaggcgggtggcgatgaccttgcgccgctcgttccaggcaatcagcaggaaagccaccagggcgaaggccacggccaccaggatgccctggttgatggcttcgcggcgcaggtccttgagcggggtcagcagggtgaagttccagggcgtatcgctcaggggccgggtctgggacaggtagctgatttccttgtcgtcggacaccagctcggtgttggccgggaaggtcagcttctccacgccttcggccaggcgttcgcgggccagcggctccagttcgttgagggtgaaccagtaatattgcaggctgcgcgccaggcgctccttggtgtcgtcgctcagcgggcgtaccgagcgaaggcgccgggccgggtcgctggagaggatgatgatgccgttctcgtcgctgacgaagccttccaggcgggcgcgttgccaacgttcttccagggcctccaggcgcaccttgaccaccgccacgccgatgatcttgccctgttcttccaggccgtgggccaggtagtagccgggctcgccgttggtactgccgatgccgtagaagcgcccgggctggccgcgcacggcattctggaaataggcccggaacgacaggtcttcacccaggtagctgtcgacgtcgcgccagttgctggtggccagcacgcggccggtggtgtccatcacgtaaatggcccgactgcggctgcgccggttcaggccttcgaggtaattgttgacggtctgccggtgctccggcgtcggctcgttgagcagcagcgacacactggattcgagttccagcaggctgggcaggtaagtgtatttgctgatctcgctttcgaccgcgcgggcgtgcagttccagctggcgttcgccgttctcgctgaggctgcggatgccgtaatgctcgctgatccagaagccgacgtagcccaggccgatcatcagcgcgatgaccagtggcggcaggaacaggtggcggatcagacggggtttcacggcgagtgatggcggcgcggcgcgatagatagtggggtcgcatttcatcacagatgccttgggtcaaccagcgctcgcccgcttcctgtaggagcgagcttgctcgcgaagaactcaaggacaacgcattatccaggatgcacgcgttatcgttaacgaccatcgcgagcaagctcgctcctacaggggcgagccgcatcgtttttagtgctgcaggattttctcgaggaaatgctgcgcacgctcggagcgggcgttgatgtcgccgaagaattcctctttcgggcagtcttcgatgattttgccggcgtccatgaagatcacccggtccgcgaccttgcgggcgaagcccatttcgtgggtcacgcacatcatggtcatgccttcgtgagccagttgcaccatcacgtccagcacttcgttgaccatttccgggtcgagcgcggaagtcggttcgtcgaacagcatgacgatcgggtccatcgccagcgcgcgggcgatcgccacacgctgttgctggccgccggacaactggcccgggtgcttgtgggcgtgggcggacaagccgacgcgctccagcaactgcaggcctttcttggtggcttcttccttgctacggcccagcaccttgatctgcgcgatggtcaggttttcggtgatggtcaggtgcgggaacagctcgaagtgctggaacaccatgcccacgcgcgagcgcagtttcggcaggttggtcttcgggtcggcgatggaggtgccgtcgaccacgatgtcacctttctggaacggttcgagggcgttgacgcatttgatcagggtggatttgccggagccggacggtccgcacaccacgatcacttcgcctttcttgacctcggtgctgcaatcggtcagcacctggaagtccccataccacttgttgatgttcttgatagagatcatacggcaaaccttttttgcagacgcttgaccagcagcgaggcggcaaagctgattgtgaaatacaccagaccggcaacgatcaggaactcattggagcggccgatgatgtcgccgctggagcgcgaagcattgaggaagtccaccaggcccacggtgtacaccagcgaggtgtcctggaacaggatgatgctctgctgcagcagcagcggggtcatcttgcggaacgcctggggcaggatgatcaggcgcatcatctggccatagctcatgcccagcgcctgggcggcgcccatctggcccttgggaatcgactgcacgccggcgcggacgatttcgcagaagtacgccgcttcgaacatcatgaaggccacgatgcacgagccgaacgcaccgatcggggtgtcttcgccggtgatccagcgcagcacgaaggggaccgccaggtagaaccaggtgatcaccagcagcagcgggatggagcggaagtagttgacgtagacgccggcgatgttcgacagcagcttgctgtgggacaagcgcatcagcgccaggatggtgccgaggacgatcccgccgacgacgcccagggccatcagcttgagggtcatcagcatgccgttccacaggccgggaatggccgggacgacgccagtgaaatcgaattccattatttgccccccacggagatcaggccgggcaccgcgactttcttctcgaccatgcgcatcagcagcatcaggctcatgttcagggtgaagtagatcagcgtggccagggtgaaggcttcaaacaggttggccgagaactcggcggtctgcttggtctgcgccagcaactccatcaggccgatcagcgaggccacggaggagttcttgaagacgttgaggaattccgaggtaagcggcggaatgatgatccgataggcctggggcagcagcacgttccagtagatctgcggcagcttgaagcccatggcgcgggccgcggactcctggccacgtggcagcgcctggataccggtgcgcacctgttcgcagacacgggcggcggtgaacaggcccaggcacacgacgacgctcaggtaggccgaggtggtcgggttgaggtcctgcttgtaccagtcctgcaggttttgcggcagcaggtccggcaccaggaagtaccagatgaacagctgaaccagcagcggtacgttacggaagatctccacgtagacggtggcgatgcccgacaccaggcggttcggcacggtccgcatgacgcccaggatcgagcccagcagcagcgcgacgatccaggccaccacggcgatggcgatggtccagcccaggcccgcgatgtaccagtcgagataggtctcgctgcccacgccggtggacttgaagaacacgccccagtcccagttgtaattcattagggtctcccctctgatcgatcgatgtacaagcacccgcttggggaaatccgttcccgcctggatgacgcccaggcacacgcgatcggctcgacaaccaccggttcgagtgtttccaaaaaaagccagcaggtagtgacaggctcctgaaagggccgtgccctttcaggagacaaggttagtcaggaatcaggactttttatcgtcagccgctttgtcggtcgggttggcgatcagggccttgagctcgtcgctcatcgggaacatcaggttcaggccttttggtggaatcggcgactggaaccatttgtcgtagatcttgttgatctcgcccgacttgaaggtggcgacgatggcgtcgtccacggccttcttgaacggtgcgtcgcccttgcggaccatgcagccgtagatttcgtaggattgcgcggtaccggtcacggcccagtcggtcggtttgcgggccttggccatttcaccggccagcagcgcgtcgtccatcatgaaggcaacggcgcggccgccttcgagcatgttgaaggactcgccatggtccttggccgagatcacgttcatgcccatctgcttgtcggcgttcattgccttgaggatgcgctcggacgtggtgccggcggtggtcacgacgttcttgcccttcaggtcggcgaagtccttgtaaggcgaatccttcttggacagcaggcgggtgccgatctcgaagatgccgacggagaagtcgacctgctgctgacgctcgacgttgttggtggtggaaccgcactcgacgtccacggtgccgttctgcaccagcgggatacgggtctgcgaggtaaccaggttgtatttgaccttgagatccggcatgtcgaggtctttcttgatggcttcgacgattttcagctggatgtcgtgggagtagccgactggaacgccggatgcatccgcgatgtaggagaacggaatggaagcgtcgcgatgtccgagggtgatggtgccggagtctttgattttcttcagggtgccggtgagttcggcggcgaccactggagtgctaatcagagcagcagcaatggctgcgcccaacagatggggaacgatgcgcatcaatatttcctcgacatttgttttttttatgaagccagttcgacggctctcttatacagcgaatgccttgacggctcctgatgtgtgttggcccatcaggcattcgtcgaagagtgtagagcatgagtcgtgccaggccagctgatccgtatcaagaccttgatttgaaaggctattaaatatttatggcggatattgtcggcggtctttatccggttatccgaattgacccgaaagtcgcgttcggaaaaccgaatgcccagcagggccgggctcattcccctgtaggcgcgaggctgcggccagaaaaaaagcccccgggccgtatggcgcgggggcttctttataggaggggcgatcaggccgcttcgatcttcgcccggttctgctcgaccttttgcaggtagtgctgcagtttttcctgttctgccggggtcgtgaacagccccagcttgctgcggcgccacaggatgtcctgggcattgaccgcccattcttcgttgcacaggtaatcgacttcacgggtgtacaggccgccacccaggtgctcgcccaggtcgttcaggctgtgcacgccttccagcaggcgccaggtgcggctgccatagctgctggcccagcggcgggcgatttcgctgggtacccagtcgaacttctggcgaatcgcttcggccagtgcctgcggggtggtcatgtcttcgccgccgggcagggtcgagtgggcggtccagctcggcttgatgcccttgaagaacggcgtcagctgggccatggccgattcggccagcttgcggtaggtggtcagcttgccgccgaacaccgacagcagcggcgcttcgtcggcattgccggacagcgccagggtgtagtcgcgggtcacggccgacgggttgtcggattcgtcgttgcacagcgggcgcacgccggagtaggtgtgcacgatgtcctggcggctcagctgcttcttgaagtgggcgttgaccactttcaggatgtagtcggtttcgccttcggtaatcgccaccttcgccgggtcaccggtgtactcgcggtcggtggtgccgatcagggtgaagtggttcaggtacggaatggtgaagacgatgcgctggtcttcgttctgcaggatgtgcgcatgttcgccttcgtacagcttcggcacgatcaggtggctgccctggatcaggcggatgccgtaaggcgaatccagcttcaggtcgtccttgatgaacttggcgacccatgggccggcggcgttcaccagggccttggcttgaattgagaacaggctgccgtcggcgcgctccaggtgcaggtgccacatgcccttgctgcggcgggcgctgatgcagcgggtctgggtatgcacatgggcgcctttttcgcgagcggccatggcgttcaacaccaccaggcgggcgtcgtcgacccagcagtcggagtattcgaagcctttggtgatctcggctttcaacgggctgtcggcaccgaacttgaggctcttggaaccggcgagtttttcccgcttgcccaggtggtcataaaggaacaggccggcgcggatcatccacgccggacgcaggtgcgggcggtgcggcaggacgaaacgcatgggcttgacgatatgcggggccttggccagcagcacttcgcgttcggccagggcttcgcgcaccagacggaattcgtaatgttcgaggtagcgcaggccgccgtggatcagcttgctgctggccgaggaagtgtggctggccagatcgtctttttcgcaaaggaacacggacaggccacgcccggcggcatcggcagcgatgccgacaccattgatcccaccaccgatcacggcaatgtcataaatctcggcgagagggggcgcgggcaaggtggaagtgggcatcgactggcctcgtgttcttctggtatttgaaatcgaacattaatgttcatttacgaaaatactagcgcagaaacacgccgacagccagcgggattcgattgaaaaaactcatcgaaaggcagggaaaggaaaatttacgaacattgtcggacgcaaagtgtctgcggcttgtgaaaggggggatctgtagccgctgccgaaggctgcgatcgcgcccgaagggcgcgcaggatctccagttcgctgaaggccttcggccttatcgcagcctgcggcagcggctacacggggagggggtcagacgacttccaggcgaatcttgtgttgctgcagcaactgggtcagcgccggaaccggctgctggtcggtgaccaggcaatcgatcaggctgatggggccgaggcggatcatggcattgcgcccgaacttgctggagtcggcggccaggatcacctgccgggcattggcgatgattgcctgggacacccgcacttcctggtagtcgaagtccagcaggctgccgtcttcgtcgataccgctgatgccgaccagggcgaagtcgaccttgaactggttgatgaagtcgacgctggcctggccgaccacaccgccatcgcgacgcacattgccgccggtcagcagcacgtcgaagtcgtccttggcgctgagcatggacgccacgtgcaggttgttggtgatgatcttcaggtggctgtgattgagcagcgcccgggcaatggattcggtggtggtaccgatattgatgaacagcgaggcgtgatcggggatctgcgcggcgatggcttcgccgatgcgttgtttctcgtcgcgcatctgatcggcgcgcatggcgtaggcggtgttttcgacactggagtcgtaggctgcgccgccatggtagcgacgcaacaggttcacttccgccagttggttgatatcgcggcggatggtttgcggtgtaacgacgaacagctgggccatttcctcgatgctgacatagccgcgttcgcggaccagctcgaggatttgctgctgacggggaggcagattcatggggcttcctttgggctgccatgcaaaatttgcccatgatgccgcaggaatctactcccgaccagttacccgatcacgtgaaaactactacgctcggaaatcctgcgttaaaaacagactcggactgctcatttacaaacacgtaaagtcgggtgcgaccccagccggtcctcgtctgtttttgccttggctttccttcgctcgctacgttttcacccgatcggccacccgatacgagtccgcgacctggcttattcagcgccttcgtgcggttcccagtcgcgggtgcggctgacggcttttttccagccggcgtagagtttttccttctcggtttcggccaactgcggttcgaactcgcgctcgatcaccgccttgccgcgcagctcttccaggctgccccagaagccgcaggccaggccggccaggtaggccgcgcccagggccgtggtttcgcgcatttgcgggcgctcgacctgggtgccgaggatgtcggcctggaactgcatgaggaagttgttggcgaccgcgccgccgtccacgcgcagggccttgaggcgttcgccggagtcctgctgcatggcgtcgaggacgtcgcgggtctggtaggcgatcgattccagcgcggcgcggatgatgtggtccacgcgcacgccacgggtcaggccgaacagcgcaccacgggcgtaggggtcccagtacggagcgccgaggccggtgaaggccgggaccaggtacacgccgttgctgtccttgaccttgctggcgaagtattcggtgtcgtgggcgtcgttgatgatcttcagttcgtcccgcagccactgcacggtggagccaccgttgaacaccgcgccctccagggcgtaagccacttcgccgcgagggccgcaggcgatggtggtgagcatgccgtgcttggacttgaccgccttgtcgccggtgttcatcagcaggaagcagccagtaccgtaggtgttcttcgcctggcccggctcgacgcacatctggccgaacagcgccgcctgctggtcgccggcgataccgccgatggcgatgccgcttttggtgcggccgtagatttccgaggacgacttcacttgcggcagcatttcccgcgggatatccagcacttccagcatcttcgcatcccactccagggtgtggatgttgaagagcatggtgcgcgaggcgttggtgtagtcggtgacgtgggtcttgccgccggtgaatttccagatcagccagctgtcgacggtgccgaacagcagttcgccgttgcgcgcgcgttcgcggctgccttcgacgttgtcgaggatccacttcagtttggtgccggagaaatacgggtcggtgaccaggccggtggtgtcgcggatgtactcttccaggccgtcacgcttgagctgctggcagatttcggtgctgcggcggcactgccagacgatggcgttgtagatcggccggccggtggtcttgtcccagaccacggtggtttcacgctggttggtgatgccgatggcggcgacctggtcatggtgcaggccggcttgcgccagggcctcgaccatcaccgcgctctgggtggcgaagatttccatcgggtcatgttcgacccagccggcttgcgggtaatgctggacgaattcgcgttgggcggtgcacacgacgttggcgtcgcgatcgaaaatgatcgcgcgcgagctggtcgtaccctgatcgagggcaatgatgtagttcttattctgaatgtcggtcatgtcgattgccttggacaaaaataaggaagtgggcaagaggcgcaggtcggggttgggcaggaccttgcgccgccggtttcaagaagttcttactttgccgtcaatggctttttcggcatccgttggagcaggggcgacggttggcaggtggcgggcaatcagcccacggtaagccacggcgccgaggcaggcaccgataatcggtgcgaagatcggaaccaggaagtacggaatgtcgcggccgccggtaaaggaaacctcaccccaacccatgaagaatgtcatcagtttagggccaaaatcccgcgccgggttcatcgcgaaaccggtcagcggccccatggcgctgccgatcacggcgatcagcaggccgatcagcagcggcgccatcgggccgcgcggcaagccgttgttgtcgtcggtcagggacatgatcacgcccatcaggatcgcggtaatcaccacttcgaccaggaacgcctgggcggtggacagcgccgggttgggataggtggagaataccgacgccagttcaaggctggcctgggagccgcggaccatctggtgggcttgttcgtaatcgaagaacaggttgctgtacagcgtgtagaccagcagcgccgcgcagaaggcgccggcgatctgggagacgatgtagaacggcagtttgcgtttctcgaagtcggtaaagatgcacagcgcgatgctgaccgcggggttgaggtgcgcgccggaaacgccggcggtgaggtagatcgccatgctcacgccgatcccccagatgacgctgatttcccacaggccaaagctggcgcccgcgaccttgagcgcggcgacgcagccggtaccgaagaagatcaacaaggctgtacccaggaactcggccatgcactggccggagagcgacggttgttgtaacgcagttgtcatggaaaacctcggtttttgttgttgtctggcactggcgtgaagggcgccgagcgcgattttcaccgtcggcaggatccccatcctgggcgcggcttactgctgggtacggctgttggatctaccacatgatattcgcaaacgaaaaaatatagacaagaaacattactgtcaaaggtcgaaagtgaaccattggtcattttataactatcagttgtgtgaatgatcttgcgggaagcgcgtgggttttgcgcaaaaggtgcggccagcctggtgccggcggctgccggggctgaggtatgggccttggaatagagccttttgctggcggatatcctagaatcgccagtgttcttttccctgcctatggagttgccatgacccctgcactggatctgctgaaaaaagttcgcgccgaacatcgggtgcacagttatgaacatgacccgaaggcggcctcctatggtctggaggcagcggaaaagcttggcctcgacccggcgcaggtgttcaagacactgttggccagcagtgaaaagggcgaattgctggtggccgtggtgccggtcgtcggaagtctcgacctcaaggccctggcgcacgcggcgggggtgaaaaaagccgagatggccgacccggctgccgcgcagcgagcgaccggttacctgctgggcgggatcagcccgctggggcagaaaaagcgcctgcgcacttttatcgataacagtgcgcaaccctttgccagcatcttcgtcagcgccggtcggcgtgggcttgaggtcgaactctcggctgccgtgctggccgagcacacccaggcggcattcgccgatatcgggcgcgactgatcgtcagtgcgccgataagtatcggcgctgtatggcaaaaaataactttctctgtggctgtcggcgtcaggacgggcagccccatgcttgcgcggcatgttcaaggagaaatgtttatgcagcttgaatttcatcaggtcgacgcgttcagcgatcgtccgttcagcggcaacccggcgatggtctatcgactgccggcctggccggccgatgagttgatgcagaacatcgccgccgagcacaacctggcggagaccgcttttgtcgtgcgcgagcctcaaggctggcgtatccgctggtttaccccgactaccgaaatcgccttgtgcggccatgccacccttgccagcgcccatgtgctgttcgagatttatggcgagccggggccgcgtatcgacttcatctgccagtcaggctccttgagcgtcagtcgcgaaggcgcgcagctttggctggatttcccggttcgcgcgccgcgcgcgatcgatggccgcgaacagctggagcgcgttttgggcacgagggtcgtggcgttactgggggctaacgagttgttcgcggtgctggagtccgagcaggcggtgctcgactgtcagccggacatggcggcgttggtcaagttgccctggcctggcgcgatcgtgaccgcgcagggcagccagcatgattttgtctcgcgctatttcgcgccggccattggcatcaacgaagacccggtcaccggctcgacccactgcgccctgattccgtattgggccgaacgcctggacaagacgagcctgacggcctatcaacgctcgacgcgcggaggggcgttgttctgtcggctggaaggggagcgggtgaagattggcgggcaggcgacgctggtagccagcggcaagctgttcctggattgaaaccgcaggcgccggttgagcggcgcctgcgctttccgctggatcagtgggcgctgctgtagcggcgaacgcccgattcagcctgtggcagctgcgccgcggtgctgccggaggcctggaatagcaccaggtgttcggcggcgacgcggattccgacgtcagcgcctatcagatgatcggcatggcttgggaagatcgactcgagctggctgccggtcggcagttgcaggcggtacagggtcgatgcgccctggaaactcttgccgacgatccgcgccttgagggcgctgtccggtgcataaacgatgtcgtccgggcgtagcagcacatccaccgcgccgccggggggccaggtgtaggcacggttgccgcgcagtacgccgagttcggtctgcaccgattccgggctgtccagctggccgcgaatgaaatagccctggccgataaagctcgccacgaacggtgtcagcggttcgtgatagaggttgtacggcgtgtcccattgctccaggcgaccttccttgaacacgcctacgtgatcgctgacggcgaaggcttcttcctggtcgtgggtcaccaggatcgcactggtgccccgcgccttgaggatgtcgcgcacttcgtggctgagcttgcgccgcagttcgccatcgaggttggaaaagggttcgtcgagcagcagcaactgcggctccggcgccagggcccgggccagtgcgacgcgctgttgctggccgccggagagctcatgagggaaacgcttgccgaggttcttcaggttgaccagttccagcagctcctcgaccacccggttcttctgcgggtgcttgcggatgccgaaggcaatgttgtccgccacgctcaggtgcgggaacagggcgtagtcctggaacaccatgccgatccgccggcgttccggcgccagggtgaagccagcgctggagatggtttcgccggccagctggatttcaccttcgtgcaccggctcgaaaccggcaatcgcgcgcagggtggtggtcttgccgcagccggaggaaccgagcaggcaaccgatatcgccggcgttgaggtgcaggttaaggttctgcacgacccgttggtcctggtagccgcaggcgagattgcgcaggttaagcagtaatggctggctcatgcgtggtggtacgccggctcgaccagaaactcgagcagggccttctgtgcgtggagacggttttctgcctggtcccacgccacggagcgtggatcgtccagcaggtcgaggctgatttcttcgccgcggtgggcgggcaggcagtgcatgaacagcacgtcttcggcggccaggtcgagcaacgcgcgattgacctggaacggcgcgaacagcttgagacgcagggcggtttcttcttcctggcccatggaggtccagacatcggtgctcaccagatgggcgccgatcaccgcgtcttgcggatcgcgcacgatgctcacccggtcgccggcgcgggcgacgaattcagggtttgggtcgtagccttcggggcaggcgatgcgcagttggaagtcgaactggatcgccgcttctatatagctgttgcacatgttgttgccgtcgccgatccaggccacggtcttgccctggatcgaaccgcggtgttcgaggaaggtttgcatgtcggccagcaactggcacgggtgcaggtcgtcggacaggccgttgatcaccggtacgcgggagttggccgcgaactcggtcagggtgttgtgggcaaaggtacggatcatcaccgcgtcgagcatgcgcgacatgacgatggcgcagtcgctgatcggctcgccgcgacccagttgggtgtcgcgcggggacaggaagattgcctggccgccgagctggatcatgccggcttcgaaggacaggcgggtgcgggtagacgacttctcgaaaatcatcccgagaacgcggtttttcaggggctcgaagagtacgccgcggttacgcaggtccttcagctcgatgcctcgacgaatcacgctgaccagctcttcgggcgtgcaatccatcagggagagaaagtgccttgcgctcatcattaactacctttttgcaacagaccgcagatactcaaagccttgtcttatcgagaaacgggcgagacctgcggcgaaagccgcacggggcgacgaaataggggaaggcgcgatcttataattaaatgtcgcgtcttaccaatagcaggcttggtttctaaggctttcaccacctgcagagagtggtttggggccaaaagtgggtcattcgtgacgttctacagcgtgttcagttcggtccagtccgatgtggagtcgatcctctttgcatcggcccggagcagcatttgtacaccgcgccttggccgctttgcaacgcgcctcgtggcgcatgccgctatcaggcatatggctggcgcgaggcctccttttccctggccgatcattcgagcggtatagggaacagcggcttgttgctggaaggtgttcggcctataaggcagacttgcgagccaacatctctgtgagtgcaagccttggaagcaggtaaagactatttcgtgcacgccaatgccctgtgtgagtccgagacaatcggcgcggggacgcgtgtctgggcgttttctcatatcctgcccaaagccctgatcggtcgcgaatgcaatgtctgtgaccacgtgttcatcgagaacgaggtgacgatcggtgatcgggtcactatcaagtgcggtgtgcaaatctgggacggtatcacccttgaggatgatgtcttcgtcgggcctaatgcgacgttcaccaacgactgtttcccgcgcagcaaggtctatccggagaagtttccgagtaccacggtcaagcgtggtgcatcgctgggggccaattgcaccattcttcctggtatcactattggcgaaaatgccatggtcggcgcgggggcggtcgtgaccagggatgtggcggccaacacggtcgtggtaggtaacccggcccgtgtcatcgggcaagtctgcgatatcagtcgcttcgactgaagtctgagtccagctgctttgccgactgcatccaggacggatgtcagccggaaatatttccaaggcaaagggctggggttataaatgcgcaccggcaacagggaagtgcttggaatggactcgaaagaacagcaattgaagacactgttggggttgacgacgcgaaccctgaccgacctgacggcatcgatcacctcgatgtccttcgagttgctacgcagcgaggacggcacaacgcgcaacgccgcgcgacagatgatcgagcgcatgctgaccatcagcagccatctcgatgagcattggcggctgcttgccgaattcagcggggtgcagggcggcgaggcgccgatgggcggcatgacgccgatcgcccggcaggacgatccaccgaggctgccctccaactgagtcatcggctggcttgatgcttgccgattcacaagacgaacgtctctggtgctgatgccggtctggcaccatagttttgttcccgcggcctgacgctggccgccccgaataaaatagagactggccatgaccaagactctccatcaccgtgcctgccacctgtgtgaagccatctgcggcttgaccatcgaaaccactgaagtcgacggcgccggcccgcagatcacctcgatcaagggcgatgcccaggacagtttcagccgcggccatatctgccccaaggcggtggcgctgcaggacatccagaacgacccggaccggctgcgccagcccatgcgcagggtcggcggcgattggcaggcgatcgagtgggacgaggccttcaacctggtggccgagcgcctggcggcgatccaggagcggcacggcaaccatgcggtggcggtctatcagggcaatcccagcgtgcacaactatgggttgatgacccacagcaactatttcctcggcctgctgaaaacccagaaccgcttttccgccacctcggtggatcagttgccgcagcacctgagcagctacctgatgtatggccatgggttgctgctgccgatcccggatatcgataacaccgatttcatgctgatcctgggcggcaacccgctggcgtccaacggcagcatcatgactgtgccggacgtggagaagcgtctgaaggcgatccaggcgcgaggcggcaaagtagtagtggtcgacccacggcgcagcgagacggcggtcatggccgaccagcatgtgtttgtccgtcccggcggggatgtggcgctgctgttcggcatgctgcatacgattttcgcgcaggggctgacgcgtgacagccatctgccggtggacggcctggccgaggtgcgtgaggccatttcccgtttcagtgccgaagccatgagtcctttgtgttcggtgccggcgcagcagatccgccagttggcgcgcgacttcgccacggcggacagggcggtgtgttatggccggatgggcgtgtccacccagtcgttcggaaccctctgccattggctggtgcaactgctcaacctggtgaccggcaacctggaccgggtcggcggcgccctgtgcaccgagccggcggtggatctggtggcggcgacttcgggcgggcacttcaatgcctggcaaagccgggtttccggacgccctgaatatggcggcgaactaccggtctcggccctggccgaagaaatgctgaccgcaggcgaagggcaggtacgggcgctgatcacggtggccggcaatccggtgctgtccacacccaacggacggcagctggagcaggcgctggatggcctggagttcatgctcagtatcgacctgtacatcaacgaaaccactcgttatgcggacctgatcctgccatcgacctcggccttggagaacgatcactacgacaccacgttcaatatgttcgcggtgcgcaatgtcagccgtttcaaccgggcgatcctgcccaagccggaaggcgcgctgcatgactgggaaatcttcgtcggcctggccagggccttcgccgcgcggaccggcaaggagctcaagccgaccgtgccgccggcgcagatgatcgacagggggctgcgcgcggggcggtatggcgaggcgtccggattcaatctgtcggtggcgacgctggccgaccacccccacgggatcgatctggggccactcaagcccaacctggcagcgcgcctgaaaaccgagaaccgccgggtacaggccgctcccgcggcgatcatggcggacctcgagcgctttgccgcgttgcaggctccggcagcggatgagttggtgatgatcggccggcgccatgtgcgcagcaataattcgtggatgcacaactaccatcggttggtgaagggcaagccacggcatcagttgctgatgaatcccgatgatctggcccggcgaggactgactgacggacagcgcgtgcgggtcagttcgcgggtcggggcgatcgaggtggaagtcctcgccagcagcgagatgatgcccggggtggtcagcctgccccatggctgggggcatggtcggccgggggtgcagatgagcatcgccatggcccaacccgggtcgagtgccaatgacctgaccgacgagcgtcagctggacgagctatcgggcaatgcggcgctcaatggcgtgccggtgaaggtggaggcggcctgaggagtctgtcggagaggccgagcatggcgctcggctttccgttacaatgcgccaccgtgtcgacaacagagtcggaaagttcagccgaggtgctccatggatatcatcgaaactattaaagagcagattgccaacaacaccattctgctttacatgaaaggctcgccgaatgccccgcagtgtggcttctccgcgaaagccgctcaggccgtgatggggtgtggtgagaagttcgcttacgtggacatcctgcagaacccggaaatccgcgccaacctgcctaaatacgccaactggcctactttcccgcaactgtgggttgccggcgagctggtcggtggcagcgacatcatggctgagatgttcgccaatggtgagttgcagaccctgatcaaggccgctgctgaaaaagccgctgccaagaccgaagcctgattcgccctcggcaggagcgacaagttagctcttgccgggttgtgtggatttatccacgcaattaaaaagccccgccctcgtgaagagaggcggggcttttttatggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctgggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaaccttttttatgggctgaaccttgaggggaattactcgtcgcccatctgcgattgcaggtagttctccaggccgactttatcgatcaggcccagttgggtttccagccagtcgatatgctcttcttccgattccaggatgtcttccagcagctcgcggctaccgaagtcgccaaccgattcgcaatgggcgatggcggctttcaggtcggcgtggccggtacgctcgatgcgcaggtcgcattcgagcatttccttggtgtgttcgccgatgtgcagcttgcccaggtcctggacgttcggcaggccttcgaggaagaggatgcgcttgatcagcttgtccgcatgcttcatctcgtcgatggactcgtggtattcgtgcttgcccagcttgttcaggccccagtcttcatacatgcgtgcgtgcaggaagtactgattgatcgcgaccagttcattggcaaggatcttgttgagatgctggatgactgtgacgtcgcctttcatgatggggtcctgccctgtaattagcggtatataaggcagagtctgagccgcacgatgattagtgtcaaacctaagttattgaataatatatgaaaattaatcggaataagaatgtttgtgttccgcgttttgacgctaagcgattgaattacaggcataaaaaagccggacatgaagtccggctcttttaaatggcgttaattacgcaacattaaattctactgggtaaggaatcgctggctggctgctttgcagttcggtcagggtttcacgtaccacctgcttggcgaggcaggcacatttgccacattgactggccacgccggtcgcttggcgtacttcacgatagctgcagcaaccgtcgtagattgcatcgcggatttgtccgtcggtgacgccagtgcagaggcagacatacataaggtgagaaccgtcgttggttatggctcaatgcgacggatcttaatgttaacgagaatgattgtcaaagtggtttcctggggctttttgccagatgcgtatctggcagacgaacggttttttctagcacgggtgacgagctgtccagcagggcggcttttttgcggcctgaacccaggggatggaaaaaccactaaggacagctcaaaaacgcggtgtatgatgtgcggtccttacgaagcgggatcgagtcacagggctgtcgcttggcggcggcacactgggctggatctcattcttcattcgatcacaccaggagatatccaatgagcgtactcgtaggcaaacaagcccctgacttcaccgttcccgccgttctcggcaatggcgaaatcgtcgacagcttcaccctgtcctcggccatcaaaggcaaatacggcctggtgttcttctacccgctggacttcaccttcgtctgcccgtccgagctgatcgccctggaccaccgcatggctgacttcaaggcacgcaacgttgaagtgatcgcggtttcgatcgactcgcacttcacccacaacgcctggcgcaacaccccgatcaatgccggtggcatcggtcaggtccagtacatcatggctgccgacatgaagcacgacatcgccaaggcctacgacgttgagtccgaaggcggcgtggctttccgtggcgcgttcctgattgacgacaaaggtgtcgttcgttcgcagatcgtcaacgacctgccgctgggccgtaacatggaagagctgatccgtctggtcgacgctctgcagttccacgaagagcacggcgaagtctgcccggccaactggaagaaaggcgacaagggtatgaccgcttcgccagaaggcgttgctgcttacctgagcgagaacgccggcaagctgtaaaccgcgcttcacgcataaaaaaaccggccccagggccggtttttttatgcgcggtcgttcagcgacggtatcagtcgttgaagtcttgccagccacccatttccttccagcgattgacgatgccgcagaacaggtcggcagtcttctcggtgtcgtagcgggcggagtgcgcctcacggccatcgaaatcgatatcggcagcctggcacgccttggccagcacggtttggccataagccaggccggcaagcgtcgcggtgtcgaagctggagaacggatgaaacgggttgcgcttcatgtccaggcgcgcgacagccgcgttgaggaagcccaggtcgaagctgctgttgtgcccgaccaggatcgcgcgcttgcagccgttggccttcagcgctttgcgcacgctgcggaagatatcgttcagcgcggtttcttcgctgacggccatgcgcagcggatggtcgagcttgatcccggtgaactccagcgccgcggcttcgatgttggcgccttcgaaaggctctacccggaaaaacagggtgtgctcggggaacacgaagcccttttcgtccatgccgatgatggtcgcggcaatttccagcaaggcgtcggtggccgagttgaaaccaccggtttcaacgtcgacgactaccggcaggtaaccacgaaagcgtgccgccattggatgacgcgagccaccaccgttgtgaccgtcctgctcgtcgtcgaaatggtcttcactcacgcgtgttcctccagcaggcgccagcgcagtttttcaccggcgcgcagcgggatgacggtcagctcgccgaaaggcaggctggcaggggcggtccattcttcacgaaccagggtgatgcgatcggtgttggccggcaggccgtagaagcgcgggccgttgaggctggcgaaggcttccagcttgtccagcgcgttgcgctgttcgaaggcttcggcgtacaactcgatcgcggcataggcggtgtagcagccggcacagccgcaggccgcttctttggcatgctgggcgtggggcgcggagtcggtgccgagaaagaacttctggctaccgctggcggcggcgtcgagcagcgcttcctggtgcacgttgcgcttgagaatcggcaggcaatagaagtgcgggcgaatgccgcccaccagcatgtggttgcggttgtacagcaggtgatgggcggtgatggtcgcgccaacgttggccgaggcctcgttgacgaactgcacggcgtcacgggtggtgatgtgttcgaataccaccttgagcgtcgggaagcgctcgacgacacggcgcatgtgctcgtcgatgaacagcttctcgcggtcgaacacgtcgacttcaccgcgggtgacttcaccgtggatcagcagcggcaggccgacttcggccatggcctccagcgccgggaagatcttgtcgatgctggtgacgcccgagtccgaattggtggtcgcaccggccgggtagagcttggcggcatggacgaaaccactggccttggccgcgcgaatttcttcgggctgggtgcgatcggtaaggtagagcaccatcagcggctcgaagcggctgccggccggccgcgcagcgagaatgcgctggcgataggcatcggcttcagcggcgttgcgcactggaggtaccaggttaggcatgatgatggcgcggccaaaggtgcgcgcgacatccgcgacagtattggtcaacacggcaccatcgcgaagatgaatatgccagtcgtcgggacgcagcagggtcaggcggtcggacattggggattccaggcgggtcaaactccagtgaatgctaccggaaaagactcttccaggcactcgctatcaagttttgcgtgaagcttccgatatcccgaaggtatgccataaacaggcatttcgattttcgtgatgtacaagtcagtggagcctcccgtgcgccagcgttatctagccttgctcagtgtgttcgccagtcttcccgcgatggcgctgactttccagacccgtctggagagcattgagtggacggtcgaaggcgataaattcgagtgccgtctgagccagccgatcaccgatttcggttccggggagttcgtgcgtcgcgccggcgagcaggcgacctttcgcctcaaggcctacaacccgatgctcgctggcggttcggccacgctgctcgcggcggccgcgccgtggcagccggggcggggcgacatcaacctgggttcggtacggctcggcagcggcgatgtgctgttcaacagttcgcaactgcaggccgggcgactgatcggtggattgatggatgggcgcagtccggtggttcgccactactcccgcgagggtggggtgtccgaggtgcgcttgttgccggtcaagttcagcaaggcgtatggcgactaccaacgctgtgtcgccaagttgctgccgcagaacttcgatcaggtcaggcaatccgaggttggcttccccgggggcggcatcgacctggacgccaaagccaagtccaggctgcaggtgatgctcgagtttctcaaggccgatccgacggtcaatcacatccagctcgatggccactcggacaacagcggcaaccgcttgaccaaccgtgacctgtcgcggcgccgggcgctggcggtgatggagttcttcaaggccaatggcattcccgagtcgcagatcgagatgcgtttccacggtgagcgctacccgttggcgcccaacaccaacgcggcgaaccgggcgaagaatcgtcgggtcaacgtacagctgcagcgtgtcccggtcgcagagaaaccggcgccccaggccgctgcccccgccaacgccgcggcgacgtcctgaaacggctgtcgtcgcccgctcgacataatctgtcgcttcgtcgtcataagctgtcgcgcctctgtaaattatccgcgttggtcggtagacttgacggctttccgtagaaccccgtggagtgatggcatggcggacgtaaacaaggtcgttctggcgtattccggcggcctggacacttcggtgatcctcaagtggctgcaggatacttataactgtgaagtggtgacgttcaccgctgacctgggtcagggcgaagaggtcgaacctgcacgtgccaaggcgcaagccatgggcgtgaaagagatctacatcgacgatctgcgcgaagagttcgtgcgcgatttcgttttcccgatgttccgcgccaacaccgtttacgaaggtgagtacctgctgggtacctccatcgctcgtccgttgatcgccaagcgcctgatcgagatcgccaatgaaaccggtgccgacgccatttcccacggcgctaccggcaagggcaacgaccaggttcgtttcgaactgggcgcctacgccttgaaaccaggggtgaaagtgatcgctccctggcgtgagtgggacctgctgtcccgcgagaagctgatggactatgccgagaagcacgcgatcccgatcgagcgtcatggcaagaagaaatccccgtactcgatggatgccaacctgctgcacatctcctatgaaggcggcgtgctggaagacacctggaccgagcacgaagaagacatgtggcgctggaccgtctccccggagaaggctcccaacaccccgacctacatcgagctgacctaccgcaacggcgacatcgtggcgatcgacggcgtcgagatgaccccggccaccgtgctggcgaccctgaaccggattggcggtgaaaacggcatcggtcgtctggacatcgtggaaaaccgctatgtcggcatgaagtcccgcggctgctacgaaacccctggcggcaccatcatgctgcgcgctcaccgggcaatcgaatcgatcaccctggatcgtgaagtcgctcacctgaaagacgagctgatgcccaagtacgccagcctgatctacaccggctactggtggagccctgagcgtctgatgctgcaacagatgatcgacgcctcccaggcccacgtgaacggcgtggttcgcctgaagctgtacaagggcaatgtgatcgtcaccggtcgcaagtccgatgagtcgctgttcgatgccaacattgcgaccttcgaagaagacggcggcgcctacaaccaggcggatgcggctggcttcatcaagctcaatgccctgcgcatgcgtattgcggccaacaagggtcggactctgttctgatgccttgagtcgttttaaaagagccccgccatgagcggggcttttttatgcctgatgttttaatcgatcaagcgggtgtctggagaccataactaaaagtttccactgaccattgtttcaatgggatctcgactatctttcagtccgctcttttcaatacgaagtgtaggaaagtcaggagtagttatatatagggggcgacgttcaatttttccttgtagggcaaatccgtattgtttgtaaggaacttctcggggcgatgctggccaagggcatggccatgccacgggccaaatgactgggttatggtgtttgcttgaaaaaccaatagcggactctggacttacccatgaagaaagttttgatcgtagatgatcatcccgtcactcgtctggctgtgcgcatgctgatggagcggcacggctttgaagtagttgccgaggcggacaatggcatggatgccctgaaactgtcttatgaacatgttccagacatccttattcttgatattggtattcccaaactcgatggcctggaagttatcgccagactttcgtcaaaagccatgtcgaccaaagtgctggtattgagcctgcaagtccctgggcctttctccatgcgctgcatgcaggctggtgcggccggttatgtgtgcaagcagcaggacatcactgaattgatcagcgccgtcagggccgtcctggccggctacagttattttcccaacgaagccttgcataccctgcgctcaagcctgggcatcgccagtgaggaggggatgttgtccagcctgtcgggtcgagagttgatggtcctgaagcaactcgccggtgggcagaccaacaaggagattgccgagggcctgtgcttgagcagtaaaacggtgagcacctacaaaaggcggctgttggggaaactcaacgcccgctcgctggtggacctgatcgagtttgccaagcgccatcagctggtatgaaggctaaggcgctacaacaaggcgcggaaggaaaaaaacagcggcttttgcgagcttttattgcgttgcgggcctgccggtctgtcggcgatgttggatccctcagccgcgcatggcctggtttgaaaagaagcgacttggaatgttggctggtgtaacaaaaaagcctccgtcaaaggaggctttttgttactaaagatcaaagtcgtaatcggccagttgcttttgcaagcgccgctcttccagaaggttgtcgatggtccgacgtttgctcaagttggtcttggccacctctaccacaggctccgcatcttctgtttcaacaggggtgaagtcgtcttctacgtccagttgttctttgccagtactcataaggttaactccaggctaagactgccattggcgctccttatatcgatattctcgggactggtaaaaaagattttttcaatcgacctatcatcaaaatcaatgattgctcaatcgtcagaggtcttgtgcttgtattcgcacaggtcctcgatccggcagcttccgcagcgcggcttgcgggccaggcacacatagcggccatggaggatcagccagtgatgggagtcgaggagatactccttgggcacgaatttcatcagtttcttttcgacctccacgacattctttccaggggccagccctgtgcggttgctgacccggaagatgtgcgtatcgacggccatggtcagttggcggaaagcggtattgagtaccacgttggcggtcttcctgccgacgcctggcagggcttcgagctcttcccgggtctgcgggacttcgctgttgtgccgttccaccagcaggcggcaggtctcgatcacgtttttggccttgctgttgtacaggccgatggtcttgatgtactcggacaggccttcgacgcccagggcatagatggcggccggcgtattggccacggggaagagcttggccgtcgccttgttgaccccgacatcggtggactgggccgaaaggatcacggcaatcagcagctcgaagggcgacgaataagccagttcggttttcggttccggattgtcttcgtgcagcctgcggaaaatttccaggcgttttgcggcattcatgggtgagtcatttccttgaaggcgatcggtgtgaggtcgaagaagcggcccaggcttgcctggcggctagcagcagccccagcaggataaaaccgccaggtgcgagtgtaagcaggtgcaagccgccctgggcggtcagaacccagcctggccagtcgacgtcgttcatccccagcagccattgcagatgattgccgagggtgccactgccgaaggcttcgcgcagcgcgcccaggataaccagcagcaggcagaacaggccggcaagacgcaagcgcacgggacgctggaaaaaatcctggtactccagcgctacgcattgcacggcaatcaggcccaggtagagggccaactgttgttgcagttcgaacgcccaggcttgcgcggccagcatggcacaactggtgagcgtggcgctgagcagaatactggcgcccaggcggccctggccagccaggcgtgggcgcagggcattcatgcacaggccgaataccgcgctcacacagagaaataccagggccagccccagggccttgaccagagagtcgctggcgccgatcaacggcgtgagcatcagggcgttctgcagggtcgaggatttattcatgggcgggacttcccagcagttgttcgcggtgctcgtcgaagtaacgcaggctgtcgtgaatcccctcgaccaccgcccgtgaggtgatggtggccccggccatctggtcgaattggccattgtcttttttcagcgcccagccggcgtcgcccgggtcacccagtgacttgccgataaaaccctgcagccaggcattcgggcgctcggcgatgcgcgcgcccagcccgggcgtttccgaatgccgcagagccttgctgcccagcagtttgccgttggcggcgacgccgatcagcagctcgatcgggccgccataaccactgacctggctgcgcagcagcacagcgctgggttggccgttacgggtggcgcgataaccggcgagcagggtgctatggctgagctggatgttatcgatggccagcggctgatccagcggctgattgtcgtagctgtcgacgggcaggagatccagcaggttgcgtgcctggatggcgcgctgttcgcgctcgatgcggggagccgtcgtctgctggacgaagaaagtgccagtggcgccgacagccgccagcagcgccaacactcccaggctccttgcgcggttcatggcagggaaggctcgggaggcggagcagccaggcgctccagggcggggacggcgaggttcatcagcagtacggcgaaggcgacaccgtccgggtaaccgccccaggtgcggatcaggtaagtcagcagaccgacgccgaccccgaacagcaggcgtgcctttgcgttcctggggccggagaccggctcggtgacgataaaaaaggcgccaagcatggtcgcgccgctcagcaggtggaaaaacggcgagccgtgggagtccgacccggaaccgttccaacacagcaggctgatgacgaacaggctgccgagcatgccggccggggcgtgccagctgaacacccgttgctgcagcaaaaaggcgccgccggcgagaaaggccaggttgacccactccacgcccttgccgccgaaatggccgaaggcggcattgccggcgaacagttcatcgatggtcaggctcttgttgatgcgcaggctgtcgagtgccgtggcctgggcccaggcatcgggcgcggtgctgtcgagggttatgccgaagatctgctgcaagccgcccagcaggtccaggccatgggaggccggccaatgagtcatctgctgggggaaggagaccagcaccagggcataaccgagcattgccgggttgaacggattcttgccgacgccaccatacaggtgcttgccgaacagcaaggcacaagtggccgcgctgactgtcagccaccacgggcaatacggcggcaaggccagggccagcaaggtggcgctgaccagggcgctgccatcgccaaggaaaggacgcaatggccactggcgcaatcgcagcgccgcggcttcgacggcaagggcggtggcacaggccagcagcagattgatcagaactccccagccaaacagccagaagagcgccagcagccccggcagggtggcaagaagcacacgctgcatggcttgttgcaggcgttcgtccggatgctcaaggggcgtcatgggcttgtacctggcgctcggcttcggccagtcgctcgcgggccttggccaacagtggcggcggggtatcgctgtggcgctccagcttgctgacttctgcccgcgcgtaagccagttcggttttcagttgccgcaggcgggcgtcgatcgggcgcttctcgacccgtaccagattgggcgccggttgcccgctggcttcttcggtcgcgtgcaaggcctgttctgcgtctttcagtgcctgctccaggctggtcagctgttcggcaggcgcctggctgtcctgggcctttttcagttccgcgcggcgcatcgccagctggatttttgcgcgcttgagctcggcgtctttggccgggggcgctgaggccagggtttcgacggtggtttcgacagcgccttccaactgcgcgagcgcttgctcggcggcctcgaactggcgctgcaggacgatcagttgcgactgttgctcgaaggttggcggatggccgaaggctttcagcgatttgttcaactgggcccggctcatcgccagatcgatcttggcttttttcaccgcggcatcggcggcggccgccttttgcgcgcgcacccgctcaatggcggactgcaccgggtccgggctggtttcactgggctgcgccgcacgttgcgcgcgggcggcccgttcggcctgcttgtgctgttcttcgtgttgcaaccgggcattgcggcgttcgaaacgctggcgcgcgtgatcgcgcttggcggtccgtgcgcgcagttcttcgagaccggtggccaggccgccgacgatcggcaatacatcattcagcggcagcggatgcatctcgatacagtccaccgggcacggcgccacgcagagatcgcagccggtgcattcgtcgatcagcaccgtgtgcatctgcttggccgcgccgactatggcatccaccgggcaggcctggatgcacttggtgcagccgatgcattcggcttcgcggataaaggccacctgggccggcgccgggccacggctgatgtccagttccatgaccgggatattcagcagcctggccaggccggcaatggtttcgtcgccgccgggcgggcacttgttgatcgcctcgccgttggcgatgccttcggcgtagggcttgcatccggggtggccgcacttgccgcattgggtctgcggcagcagggcgtcgatgcgttgaatcagactcatgggttgagcagtccgttgaaaccgagaaatgccaccgccatcaggccggcgctgatcaggtcgatcggcaggccgcgaaagggcaggggcacatcgttgttgaaaatgcgctggcgcaggtcgctgaacagactcagcaccagccagaaaccgaggcccgcacccaggcccagggcgaggctatgaccgattccccgattggcctggaccgccagcagcaacgcgccgagcacgccggcattgcccagcagcagcggccagaggccgtcgaatggcagcccgggcaacatccggcttagcagcttgagcagcggtgcgatcagcagcacgcccagcggcaggaacacgaacagttgcagcgaggtcaggcccagcggtaccagcagcgcctgataaagcccgtagcccagcaggctgcagagcagcatcaggcaactggtggcgatccccagggcatggatccgccgccgcgcaacctgcggctcggcactggcctgcaacagcggatcgacgcccagcggccactgcaacacgaagttgttgatcagggcagcactgatgagcgtgaggacaatctcggtcatgttcgtggccggtgagggcgggcggatacctgaagactaggcaattatccggcaagggcgcaggcccatccagatatgaaaatccccccgccacgcagcggcgcgacggggggatcgatccagcaggcggagttacttgatccgctggcctggcttggcgccgctgtccgggctcagcaggtagatctcttcgccgccggggccggccgccatcaccatgccttcggaaatgccgaatttcattttccgtggcttgaggttggcgatcatcatggtcaggcgaccgtcgagcttggacggatccgggtaggcgctcttgatcccggagaacacgttgcgttgctcgtcgccgatatccagggtcaggcgcagcagcttgtcggcgccttccacatgctcggccttgacgatcagcgccacgcgcagatcgacggcggcaaaagtgtcgaagtcgatttccggcgacagcggatccttggccagctcgccgttgcccgcaggcttggcttcaccagtgtcggtctggctggcggtcaggtcttctttcgaggcgtcggtcatggcttgtactttcacggggtcgatccgcgtcatcagcggcttgaattcgttcaactggtggttgctcagcaggtgctggtggtcgttccaggtcagcggggcgacattgaggaacgcctcggcgtcggcggccagcagcggcagcaccggcttgaggaagatcaccagctggcggaacaggttgacgccggtggcgcagatggcctggacttcatcctgcttgccttcctgcttgttcaacgaccacggcgccttgtcggcgatccaggcgttggcgcggtcggccagggccatgatttcacgcatggcgcgggcgaagtcgcgagcctcataggcgtcggcgatgctcggcgcggccgccaggaaggcctcggtcagctccggcgcggcattctggtccaccagcacgccggcgttgcctttgtggatgaagccggcgcaacggctggcgatgttcaccaccttgcccaccaggtcggagttgaccttctgcacgaagtcttcgaggttcaagtccaggtcgtcgacgccgcggcccagtttggctgcgtagtagtaacgcaggtattccggcgacaggtggtcgaggtaggtccgggccttgatgaaggtgccgcgggacttggacatcttctggccgttgacggtcaggtagccgtgcacgttgatgccggtcggcttgcggtagccggcgccttcgagcatggcgggccagaacagcgcgtggaagttgacgatgtccttgccgatgaagtggtacagctcggcggtcgagtccttgccccagaacgcatcgaagtccagctccggcgtgcggttgcacaggttcttgaagctggccatgtagccgatcggcgcgtccagccagacgtagaagtacttgcccggctcgtcggggatctcgaaaccgaaatacggcgcgtcgcgagagatgtcccactgctgcaagccgacatccagccattcggcgatcttgttcgccacggcgtcctgcagggtgccgctgcgggtccattgctgcagcatctgctggaagtccggcagcttgaagaagaagtgctgggaatccttgagcaccggggtggcgccggaaatcgcagacttcggatccttcaggtcggtcggcgcgtaggtggcgccgcatttttcgcagttgtcgccgtactggtcctcggtgccgcatttcgggcaggtgcccttgatgaagcggtcggccaggaacatttgtttttccgggtcgaaatactgggtgatcgagcgcgtggcgatgtgcccggcgtcgcgcagcttcaggtagatctggctcgacagctcacggttttcttcagcgtgggtcgagtggaaattgtcgaagtccaccaggaaatcggcaaagtcggcgctgtgttcggcctggacgttggcgatcagttgttccggggtgatgccttccttttccgcgcgcagcatgatggccgagccgtgagcgtcgtccgcgcagacatagatgcattggttgccgcgatgcttctggaagcgcacccacatatcggtctggatgtactcaagcatatggccaagatggatggaaccattggcatagggcagggcgctggtgacgaggatcttgcgtggctcggacatggggctcggctacttgatgaaacggaggtcggccactataaagcgccgagaaatatatttcaccccgtgagcccggttttccacggccgtcgtagccatcggcgggcatgctatatgatgctttggcatcccgcccacgccacggaacaggtaggatagccgcctgattttcccgtcttgttatcggagttgcccatgagcgccgtcaatcgcgcagcggtggaagccgttcttcgccaatacaccgacccctacctgaaccaggacccggtcagcgccggttgtgtccgttccatcgacatccagggcgacgaggtgcgtgtcgagctggagatcggttatgccgccggtctgttcaagagtggctgggcccagttgctgaagctggccatcgaaaacatggacggcgtggtcatcgctcgcgtcaatgtcaccagcgtgattgccgcgcacaaggcccaggcgcagattcccggcctggccaacgtcaagaacgtggtggcggtggcatccggtaagggcggcgtgggcaagtccaccaccgcggccaacctggccctggccctggcccgcgaaggcgccaaggtggggattctcgatgcggacatctatggccctagccagggcatcatgttcggcatcgccgagggcacccggccgcaggtcaaggaccagaaatggttcgttccgatcaagtcccacggcgtcgaggtcatgtccatggccttcctgaccgacgacaacacgccgatggtctggcgcgggccgatggtctccggcgccctgctgcaactggtgacccagaccgcctggggcgacctggactacctggtgatcgacatgccgccgggcaccggcgatatccagctgaccctggcgcagaaggtcccggtggccggcgcggtcatcgtcaccaccccgcaggacctggcgttgctggacgcgcgcaagggcgtggagatgttccgcaaggtcaacatcccggtgctgggcgtggtggaaaacatggccgtgcatatctgctccaactgcggccacgccgagcatctgttcggcgagggcggtggcgagaagctggcgacccagtacggtgtcgagctgctggcctcgctgccgctgtcgatgctgattcgcgagcaggccgacggcggcaagccgaccgtgatcgccgagccggaaagccagatcgccatggtctatcaggaactggcccgccatgtcggcgcgcgcattgtgttgcaggaagccgcggcaccggcgatgccgaacatcaccgtcagcgacgactgagccggttgggccaacaaaaaagcccggtgcgctgcaccgggcttttttatgaacatttcatgggtgggtttcagatccgcaggccgccgtccagctcgagaatccggccggtgtaatagtcgttctcgaagatgtaggccgccgaatgagcgatttcttccggcttgcccatacgcttgagcgggatgccggaggtcattctttccagggcctcgggtttcatgccctgggtcatttcggtttcgatgaagcccggtgcgatgccggccacgcggatgccgtagcgcgccagttccttggcccaggtcacggtcgccgcggcgaccccggccttggccgcggagtagttggtctggccgatattgccggcgcgggaaatcgacgagatgttgatgatcgcgccactggttttcagctcgaccatcttcgccgcgacttcacgggtgcagaggaacacgccggtcaggttgacgtcgatcaccgactgccactgggccaggctcatcttgctcatctcgccgtccttgaccttgagcagcaggccgtcgcgcaggatgccggcgttgttgatcaggccgtgaatggcgccgaagtctgcggcgacctgggcgaccatgtgttccacctgctcttcatgggcaacgttgcacaggtaggcgcgggcctcgactcccgcggcctggcaggcggcaacggcctggtcgagcttttcctggttcaggtcgaccagcgcgagcctggcgcctttgccggcgaaatactccgccatggagcggcccagaccctggcaaccgccagtgataatgattactttgtcattgagttgcattcgcatgctccgaaagcagaactggagtggtgtccttcgaggcgcctctcttgtgcgtcgggcatggcctggctgcagattgagaattgccccgatggcgttgctggaactttgctccagacgcccgtccgttttagacggattctatataaggagtcataaattgagcgttgaagctgcgaagcatgcacgagaattactgctcaaggaataccgtggcgtgctgtcgacgcactccaaggccatgccgggttttcccttcggctcggtggttccttattgcctggacgagcaggggcggccgctgatcctgatcagccgcattgcccagcacacccataacctgcagaaggatcccaagtgttcgctgctggtgggcgagcgcgaagccgaggacgtccaggcagtggggcgcctgacctatctggccgaagccgaaaagctcgaagacgccgcggcgatcgaggcggccgccgaacgttactaccggtatttcccggagtcgcagaactaccacaaggcccacgatttcgatttctggcggctcaagccggtacgtcatcgctacatcggcggctttggcgcgatccactggatcgaccaggtgacgctggccaatccgttcgccggcaaggccgagctgagcatggtcgagcacatgaacagcgatcacgccaaggcgattgcccattacgtggacctggccggcctgccgaaaactgccgcggcgcaactggctggcatcgataccgaaggcatgcacctgcggatcggccaggggttgcactggctgccgttcccaagcccttgtaatacgccgacacaagtacgcgaggccttggtttttctggctcacgccgagcaatggccgaaaaatgccggggccgaggcttgaattcacgaattgccgacgtcatctagggtctactggaaggcattcttccgtagaggaaaccatttgatgcgcccttttctgttgctatttctgctgttcccggtgctagagctgttcgtcttcgtcaaagtcagcggtgcgatcgggtttttcccggcgctgctgctgatcatcctgggttcgatgctgggtgtgctggtcctgcgcgtcgcggggctggccacggcattgcgtgcccgtgaaagcctgaaccgcggcgaattgccggcccagaccatgctcgaaggcctgatgctggccctggcgggcggcctgttgatcctgcctggcttcatcagcgacatcttcggcctgttcatgctgttgccgatcactcgtcgcctgctggccaacaagatgcgccagcgcgccgaagaacaggccattcgtcagcgtgccttcgccgacgacatgcaggctgcccgtggcggacccgcgccgcagcgccccctggggcgtgagccgaatgtgatcgaaggcgagttcgagcaccgcgattcctgagtctctcaatgattgacacggcaccttcgggtgccgtgttcgttttgcccgactgaaaatctaaaaaaattcactgggcagcccttgtaataagcatatgcgcccacatgtatcggtcaccgcaaggtttctggtggcgacaccagacagacttccgcgtctcgctcgtcgagccgcaaccggccacgccggatttgttaacccgccggtaacgacaccggccgctgaaaaccataattaggagagatcgacaatgaagcttcgtcctctgcatgaccgcgtcgtcatccgtcgcagcgaagaagagaagaaaaccgctggcggtatcgttctgccaggttcggctgctgaaaaagccaacaccggtgaagttcttgctgtaggtccaggccgcgctctggaaaacggtgaagtacgtgcgctggccgtgaaagtgggtgacaaggttgtgttcggcccttactccggcagcaacactgtgaaggtagacggcgaagacctgctggtaatggctgagaacgaaattctcgccgttatcgaaggctgattacccgctcattttcccgttactacaaagtatttaaggaatatcgatcatggctgctaaagaagttaaattcggcgactccgcccgcaagaaaatgctcaccggcgttaacgtcctggctgacgcggtaaaagcgaccctgggcccgaaaggccgtaacgtgatcatcgagaagagcttcggcgctccgaccatcaccaaggacggcgtttccgtcgccaaagaaatcgagctgaaagatcgcttcgaaaacatgggcgcgcagctggtaaaagacgttgcttcccgtgccaacgatgacgccggcgacggtaccaccaccgctaccgtactggctcagtcgatcgtcaacgaaggcctgaaagccgtcgctgccggcatgaacccgatggacctgaaacgcggcatcgacaaggcgaccatcgccatcgtcaaagagctcaaaggtctgtccaagccatgcgccgattccaaggccatcgctcaggtcggcaccatctccgccaactccgacaactccatcggcgacatcattgccgaagccatggaaaaagtcggtaaagaaggcgtgatcaccgttgaagaaggctcgggcctggaaaacgaactgtctgtcgttgaaggcatgcagttcgaccgtggctacctgtccccttacttcatcaacaagccggacaccatggtcgccgagctggacggcccgctgatcctgctggtggacaagaagatctccaacatccgcgaaatgctgccagtgctggaagccgttgccaaagccggccgcccactgctgatcgtggctgaagacgttgaaggcgaagccctggcgactctggttgtgaacaacatgcgtggcatcgtcaaagtcgctgccgtcaaggcaccaggcttcggcgaccgtcgcaaggccatgctgcaggacatcgccgtcctgaccggcggtaccgtcatctccgaagagatcggcctgagcctggaaagcaccaccctggagcacctgggtaacgccaagcgcgtgatcctgtccaaagaaaacaccaccatcatcgacggtgctggcgttgaagcggacatccaggctcgtgtgacccagatccgtcaacaagtggccgacacttcgtccgactacgaccgtgaaaaactgcaagagcgtctggccaagctgtccggcggcgttgcggtgatcaaggttggcgccggttccgaagttgaaatgaaagagaagaaagcccgcgttgaagacgccctgcacgctacccgtgcagccgttgaagaaggcgtggtacctggcggtggcgtagctctgatccgtgccctgcaatcgatcagcggcctgaaaggcgacaacgccgaccaggacgtgggtatcgctgttctgcgtcgcgctgtcgaagcacctctgcgccagatcgttgccaactccggcgacgagccaagcgtagtggtcgacaaggtcaagcagggtgaaggtaactacggttacaacgctgctaccagcgaatacggcgacatgatcgaaatgggcatcctggacccaaccaaggtgacccgttcggcgctgcaagcggcatcctccatcggcggtctgatcctgaccaccgaagcggctgttgctgaaatcgttgaagacaagcctgcggctggcggcatgccagacatgggcggcatgggtggcatgggcggcatgatgtaagccagccttacccctgtacgaaaaagccccgccggcgaaagccggcggggcttttttatggacgggagtttttgcctgggccatcgccgcgagcaagcgcgctcctacaggtgtgcctggttttgtaggagcgagcttgctcgcgaaaagacctcaggccttcaccgcttccgtctccatcaccggctcggctttggctgccggtcgatagagaatgaagtagtacgcccccaggcagatcagccagcagaagatcgcggtccagacgttgtgggagaagaagtgcgcgccctgcagcatgcgcccgaccgagaacaccgtgccgagggcaaaggcgaacaccagcgccttgcgcgccaggcgcggacggcgatcacgcaggacaaaaaacagcgcgaacagggtgaagccggtggcggcatggccgcctggccagcagcgaccaggcttgtcggtcgctggccgggggctgagcagttcgctgtaggtttccttgccaccgaactctttcaggctccacgggcactgcacggcggtgaccgccttgaccggggtgacaaaggcggtggccaggcccagggacagcaccaggcaacccagctcgcgcttgaacggcttgagacgctggacgaagaaggcgccgatgaagccgacaatggccagcaccgaaaagacgatgaccagctgcttggcccggtcatgcaggatattttccaggaaataactgtggccgccgatgaaaccgccagcggcggggtcataaaagtaccgggccaggtccatgtccagggtggtcagttcaagcagcagcaggatgacggcagccagggcgggaacgcccaggcagatccaccagttcagcgctctggaggcggggcgggcgagggtcaaagccatggaaagtccttcgagggaagcgttgcggtcgcgggttcccgcggagtctggagtggcccttgtcgtcagcgtgtgaaccctgggtgaaaaactcgtcaaggccctggaaccctgcggcggcattcgccgcgggggcttgaacaaccctagccgtcagccacgcttggccttaagctgcgcgagccaagacgggcgtaactgtgtgcggagagagtgcccatgcgaattctactggttgaagacaaccgcgatattctggccaacctggccgactacctggggcttaaaggctacaccgtggactgcgcccaggacggtctgtcgggcctgcacctggccgccaccgaacattacgacctgatcgtgctcgacatcatgctgccgggtatcgacggttacaccctgtgcaagcgcctgcgcgaagacgcccgccgcgatacgccggtgatcatgctcaccgcccgcgatcaactggatgatcgcctgcagggcttcaagtccggggccgacgattacctggtcaagcctttcgccttgtccgagctggccgcgcgcgtcgaggcggtcatgcgccggacccagggcggcgggcgccgggccctgcaggtcggcgacctgagttatgacctcgacaccctggaggtcacccgcgaagggcgcctgctcaagctcaacccggtggggctcaagttgctggcggtgctgatgcagaagagcccccatgtgctgcgccgggaaattctcgaagaagcgctgtggggcgacgactgcccggacagcgacagcctgcgcagccacgtccaccaattgcgccaggtgatcgacaagccgttcggcaaaccgttgctgcataccgtgcacggtgtcggttaccgcctggccgagggtcgtgatggagtttaagcaaagtctttcccagcggatcatcatcgcctttgcgctgatgagcgcgctggtcgctggagccttcgccctgggtatcgtggcgacggtgcacctggtggaagagaagctgatttccgcgggcctggggggcgaccttcagcgtctgctgttgatggacaacgtttccgactggagccaccgtcccgagccggaccagctgttttacttcagcggcgggcgcggcgacttcgagctgcccaaggatctgcggcatctggatccgggctttcatgaggtcttccgcgaacagctgtcgtatcacgccatggtcgaagtggtcgacggtcgacgctatgtgctgctacaggatcagagcgatttcgaagagcgcgaacgggtgctcttcgcggtggtgctggtgggcttcgtgctgagcctggccttggcggtgttcctcggctgggtgctggcgcgtcgggtgatggcgccggtggtgaggctggcgcggcaggtgcgccatcgcgaccagttgctggggctggcgccgccattggcaccggactacgcggccgacgaagtaggggagttagcggtggccttcgacgccaccctggggcgcttgcgccaggccctgaaccgcgagcgcctgttcaccagcgatgtcagccacgaactgcgtacgccgctgatggtgctggccagttcctgcgagctgttgctggaaaacccggcgatcgatcagcgcggtcgggcccaggtcgagcgcatcgcccgggcgtgcggcgaaatgcgtgagctggtccagaccttcctgatgctggcccgcgcccagcgcgaagacggcggcatgtcgccccaggcgaccttgagccaggtggccgaggacctggtgagcctgtggggcggaccgatccggcaaaagggcctcgagctgatcttcgacgccggccaaccgctggacacccgctataacgccacctttttgcacgcggtgatgggcaacctgctgcgcaatgccttgcattacaccgagcatggcttcattcgcttgagccttgagccgagcggctttgtggtcgaggacagcggtgtgggtattcccgaagagaaacgcgaggcgatgttcgagcctttcgtgcgcggcaacgagaagcgcggcgagggcctgggcctgggtctgtcgctggtgcagcggatctgcgaggaccagggctggagcgtcagcctcagcaccatggagcccaacggctgccggtttcatgtcgagttgaaccgccgcacggcatgatgggtctccatgactgctgcgcgggtcgtcccgggaatttccccggttgatggccccaggccacttatgggagcctgtaaaactctgaaatatttccactctggaccggacgaagttttcacaaagacatgacctgacgctgacaagccgctgcctaaggtggggccatcagattcaggagactgtgtgatggcgaccccgatcaagctggaattttccgagaagtacgacgagcagcatgctcaggagtatctgctcaagcatcaggatggcgtcgctcgccgtctgtcccacaagcgtgacgagcagttggcgcgtgcggcgctggccatggccggagagccggggctggtgcttgatctgccttgtggtgccgggcgtttctggccgttgctggcggagaaacccaaccgcgtgatcatcggtgcggacaattccgcggcgatgttgaagatcgccacggtggcgcaaccggccgacgtggtgaaacgggtacaacccttgcaaacgtctgccttcgacatcgacttgccggacaacgccgtcgacagcattttctgcatgcggctgctgcaccacattggcgagtcgtcccatcgcctggctctgctccgggagttccagcgggttacccgggacagcgtgatcgtttcactgtgggtcgacggcaatttcaaggcctggaaacgcaagcgcatggaagtgcggcgcaaggaggaatccgggcaggaaggttaccagaaccgttttgtgttaccggctgccacggttgaagaagaattcaagcaggccgggtttcgcgttcaggatcatctggacttttttccgctctacgccatgtggcgagtctacgtattacgcaagaggtaacaggatggccgttgaatgtgcaccgggaatggaagtcgctgctgcggaccgtttcgactacttctggaatcagcagggggagtgggtcgaagagcccaatcaacgtcgaggcggggaaagtggcgtccaacgtcttccgggcactgacgggcgtgtgctgtatgccaagcgccaggtcggccatatctatcgcagctggttgcaccccttcggccgccccacggtgctgcgcgaacaggatgcgctcaagggcctgagccagctcaacgtggcggtgccgcacctggtgttctgcggtgcgcagcgtgattcccagggccagtggcgtgcgttgctggtgaccgaggcgctggacggcttcgtggaaatcgaccactggtacgctgctggcgagcgcgagcgccacggcgaggccctgcacgagcgtgtgctcaaggaactggcggccacgctggcgcgcatgcaccggggccgctggcagcatggctgcctgtatagcaagcatgtgttcgtgcgggtcacgggtgagggcgaagcggcgaaggtggatatcgcgctgctggatttcgagaaatgccgccaacgcctgaccgctaaacgggccgccgcccatgacatcaaacaattgcggcgccactcgtcgtggagcaccacggactgggacaaactctactatttttataggacggcgtttggcagcgctatcaaaggcttatagtgatgaagctcgaaattgcacgaggtttgtttttagtaggagccttggcagttgcatccttggcggtggctgcatgggagcagccacgcatggaagtcctcagtacggcgcagggtgatgcgcattgcccgttgccacgggtcgtcaagacgacccagggagcccaacccgatcgtgacctgttgttgttcatgttcggcctgactcagggaatgaggccacagagttgaagaccatcaagcccgataaaaaggcctcgcatcgcgaggccttttttattgcgcgcccttcacttgtccggcctggccagcagggtgtagatgcagggcagcacgaacagggtgaacagggtgccgatcgacatccccgtggcgatcaccgtgccgatgtcgaaccggctgaccgcaccggcgcccgtggccaggatcagcggcaccatgccgaagaccatcgccgcggtggtcatcaataccggccgcaggcgaatggccgcggcggcttccacagcctcgcgcggcgtcagtccctggtccttgcgcagctggttggcgaactcgacgatcaggatcccgtgcttgctgatcaggccgatcagggtcaccagcccgacctgggtatagatgttcatgctcgaccaaccgagaaacagtgggatcaaggccccgcagatcgacagcggcaccgtcaccaggatcaccaccggatcgcggaaactctcgaactgcgccgccagcaccaggaaaatgatcgccagcgccaggccaaaggtcacccacagcgcgctgccttcctggacgaactgtcgtgaggccccggcatagtcgaaggcgtagcctggtggggtctcttcctcggcgatctggcgcacggtatcaatcgcttcacccatgctcacgatcgggaatccggaaatggtcgcggcgttgagttgctggaactggttgagctgccgtggccgggcccgatcgtggacagtgatcagggtcgacagcggtagtgcctcgcccttggcgtttttcacgtagtagttgttcagccattcggggttgtcgcgataaggccgttcgacctgggcgatgaccttgtagctgcgcccctcgatggtgaagcggttgatttccgcttcgccgagcaaggtggccagggtcccgcccaggtccagcatcgacacccccatctgcgcggccttggcgcggtcgatgtcgaccaccacttccggcttgtcgaaggccaggtcgatatcgacaaaggcgaacttgcccgattccatggcgcgcttcttcacccggtcggacagttccagcagcgactcgtaatcgttggggctattgatgatgaaggcgaacggcagcccttcgccggtgtccggcagggacggcaggttgaaaccgaagacctgcagcccggcaatgcccgtgagccgggcctggacttcgggcaggatctgcatctgcgtgcgcttgcgctcgttccagggcttgagcaggaagccgccgatccccgattgcacgccgttgaagccgttgatctggaacgaggagtagtactcggggaacgtcttgaagatctccaggaactcgtcggtgtaggcgttgaggtaatccaggttggccggctggggcgcggtggccatcatgaaaatgatgccctggtcctcgtccggggccagttccgacttggtgaacttgagcagggccgggatcaggcacagcacgatcagggcgaacaccaggaccaccggccgagtgttgagggtgccatgcagcaggctttggtagcggcgcttgaggctttcgaaaatcaggtcgaggcggtgggccaggccgctggggttttcatcgtggcgcagcagcagggcgcacatcatcggcgacagggtcagggcgacgatgccggaaatcaccaccgcgccggccagggtcagggcgaactccttgaacagcgccccggtgagcccttgcaggaagccgatgggggcgtagaccgccgccagggtgatggtcatcgacaccaccggtatggcgatttcccgggcgccttcgagggccgcgtccagcggcgtcttgccttcctcgatatggcggtggatgttttccaccaccacgatcgcgtcgtccaccaccaggccgatggccagcaccatcgccagcagggtcagcaggttgatcgagtagcccatcaactgcatgaagaacatcacgccgatcatcgacagcggaatggtcaccaccgggatcaccaccgaacgcagcgcgccgaggaacaggaacaccaccacgatcacgatcagcacggcttcgaacagggtcttcactacctcgttgatcgaggcctggatgaacagcgtggcgtcgtaggcgatctccgacttgaggttgggcggcagctgggcctccagctccggcatgatcttgcgcacttccttgatcacgtccagcgggttggcgttgggggtcgccttgatgccgatatagaccgaaggaatgccgccaaaggaactgatggcgttgtagttctccgcgcccatctcgacccgtgccacgtcgctgagcagcacccggctgtcgccctcggtccgcaggggaatggcggcaaaggcttcggcggatttcagttcggtgctggcgttgatactggtgaccacatactcgcccttgatctcaccggccgcggacaggaagttgtagcggcgcaccgcgctggtcacgtcgctggcgctcagaccgtagccggcgagcttgaccgggtccagccacaggcgcatggcgaacacctggttgcccaggatctcggcctcggccatgcccggcagggtcgccagcttcggctggatcacccgcgacaggtagtcggtgatctgcgggttgctcagctcctggctgaagaagctgatgtacatcagcgccgaggcgtcggcggcttccttgctcagcaccgggtcctcggcgtcctggggcagcttgttcttcacctcgttggccttggccagcagctcggtgaacaggcggtcgctgttggcgccgatacgggcgtagatcgagatcaccgagaagttctggcgactgaccgaggtcatgtagtcgatgccctcggcactggccaggctctgctgcatcggttgggtgatatagccctggatggtctcggcgttggccccggggtaggcggtggttaccgtgatcagggcgttttccatttgcggatactggcgcagcggcagtttgctccaggcctggaagcccagcagcacgatcagcaggctgaccacggtggccaggaccggacgacggatgaacggatctgtaaaagccatgaggattccttgatcagttcgcgcgtggctggccgctctgttcggggggcaacatcttgtccggggtgatggcgatgtgggcgccatggtccagcttgatctgcccggcgctcaccacctgttcgccgctgctcacgcccttgttgatcagcaccaggccgttgcgccgttcgccggtttcgatgaagcgccgctcggcgatcagcaccggctggcccttgtcgtctttctccgggctgccatcggcggcctttttctcggtcaccacgtacagcgaattaccgtacagggtgtaggtgatggcgctttccggtaccaccacccggggctgcggatcgggcagcagcacctgcaggttggtgaacatgcccggcagcagcttgccgtcgggattggccagggtggcgcgcacctgcacgttgcgcgtggtgtcttcgaccttggggttgatggcgctgatggtggcggtgaactgttccgccggataggcggagaccatcatgctgaccgattggcccagggcgattttcggcacggcctgttccgggacgaagaagtccacgtacaggctgctgaggtcttgcagggtggcgatcaccgtgccgctggcgaggtagtcgccgacatccacatggcgaatgccgatggtgccgctgaagggcgcgagcaggcgttttttcgccagcgaagccttgagctgattgaccgtggccttgttcttttgcagcaccgccgacagccgatcgtattcgccgcgggaaatcgcctggctgcccaccagttggctgccgcggccgaagtccagccgggataggcccaggtcggcctgggcggtttccagcagggcgctttccacgtcgctgtcgagttgcagcaagggctgcccggcgctgaccttctgcccggactcgaactgcagctccttgacggtgccggccacttccaggctgaggttgaccccctgcagggccttgagggtgccgaccgtgggcaggcgggtttgccacggttgttcgcgagccgtggccacggccacgctgatcggcggcttgggcaccgagaagagcttgacctgctgatagatggagaaggccttgtagcctgccagcaacagcacgatcagcaggacgacacccaacatgataaacatgcggcgacgcagcatattccggttccttggaaaacgaagctgggaaaaccaagctgattgccgaagacattactccgactttccgggggcttccagatgacaatccggtcatccggagtcctgttttccaatcctgcgcggcggcgaaaaactagaccaggtgcaaatggttgtcccagagccctgccggcaaatccaggggttttgccacccgttgtttctggcgacagtcatagaagcggcaacgcccctggcccgaggtcacgacaaaaccatccgccaccgcaccgaccccggcacagtccggcaagggcgcgtccaggcgcacttcggcgctgtccaggtcccagatgaaaaaacggttgccgcgcggggcggtgagggccaccaggcgcagttcgctgtgcaccgcgacgctggcggtgtaatgccccattgcctgcaactggtgctcggccaccgggaaggcctggaacggctgccccgggcgcttgatcgccagcagttgcgacgactcatgggcatcgcccatgaactgctggccggtgacgatggtgccgtcgccggcgatgcccatgtggcgcacactgttcatctgctgggccagggtttccttgctcagcaggctgccgtcgcgctgcatcagcaccaggctcggctccatggcgtcgaggttcatctcgacgcggctttccgcctcggtgcgaatcccgccgttggccaccaccagggtttcgccgtccggcatccatgacacctggtgcgggccgatgccgtgggtcgggatctcgccgctgtgcaccaggcgttcgccctcgaaccggtataccccgagcaggccacgacccggatcgcttgtgtcgttctcggtggcgtacagccagtcgccgctcttgtggatcaccgcgtggccatagaagtgccggttcggctgcgaggccagggtttgcaggagggcgccgtcgcgcaggtcgatcaggtagctttcggtgcccgggcgacgggcgacgaacagggcgatcggcagcgtcgggtggttgacgatgtcatggcaacgttgaccgacccgggtggcgaacacttgcgtgccgtccaggcgatagccgacggcgtaatgcttaccgtcgccgtcatcgcgcgccgagagcagcagtgggccttggtccttgtgcttgaacagcgtccagccacccagcgtgacggcgctcagcagcaggctgccgagtgccaaagcctgacgtcgcagcatgatcagtcaccgtcgttggcgttgaagcccagttggatgcccagcgccttggccagctcgccttcgtgcaagcggtggacgacgttgaggctgtcgtagatatcgttcagttgctggcggccggcgtcgtcggccagcagctcggtcagcgaacgctgggtgctggcgaacagcttcagcgaggcggcgtaggcggcatcgattttgtcggccagtggcttctgctcggccggcaacaggccgcgcaggcccttgttgtcgactccggcccagacggtctgggccgcggcgaggctggcttccaggctctgcatggacgactggctgcgccaggcgtcggcctggaacggctgtggaatgcccttgctctgacggcccatcggcgtgccgagcttcttcttcagggtgtccagcgcggtgacctggacccgcagcagatcagcgatggcctcatgggagtcggcgtagcgctggttggggaacttgctcatctgcgcgagcatgccgtcgctggtgttccagcgcgacaggatctcttcggcgagctgcttctggcgttcgccaatggcgctcagcagcgggcagtagcgggctttctgctcgctgttggccatgtcgatcttgctgtcgaacaggatgtattcgtaggccgagaggccttgcaccacgacgctggacttggccagggcggcggcgtcgatctgcggcgtggcgctgaccagctgttcgacctgacggccgaccaggttcttcttgtccggccagaactgcacttgccaggagcggttgccctcggccagcggcccgatcagcaagggttgcagttcggcccaggctttctgcgcgtgcaggaagtcggcacgggcggtgtccaggctttgcttgccttcacagaaggccagggcgctgatcgccagctggcggtcggcttcgacccaacggctgtaggtcggcaggatcacctgtttggcgatggccgccgaggtcacggcttgtgggtcctgcggcgagcaggcgcccagggcgagcgcggcaaggctggtgaacaacagcttgggacggaacatgttcgggctcccgtttcttgtaagaaggcgttaaagagaattcaggaatgccagcaacgcagcgcgctgttcggcattgaaggataaaacctgtcgctgcgccgcctgggcctcgccgccgtgccagagcacagcttcgagcaggttgcgggcgcgaccgtcatgcaggaactgggtgtggccgctgaccgtttgcgtcaggccgatcccccacaacggcggcgtgcgccagtcgcggccgccggcctggaattcgctgcggtggtcggccaggccttcgcccatgtcgtgcagcagcaggtcgctgtaggggcgtatcacttgattggccagctcgggttccgcggcgtcggcggcggtggtgaaccggggggtatgacaggactggcagccggcctggtagaacaggttcttgccggccagcacctgtggcgagccaacctcgcggcgcgccggcaccccgaggttgcggctgtagaacagcaccaggcgcaggatgttgtcgctgacttccggttcgccatccggcccgttgccgttgggggcctgcttgcaggcggtctgggcgtcggtgcagtcatcgaagggtctcaggctggtggtcaggcccatatcaccagagaacgcgtgaacattttgttgattgaggttgggctgtccggctttccagccaaaacgcccgagtacggtcttttgctgggcgtcgtcccagacccggttcggccgtccggcaatgccattgccagccttggcttgcgcttgggcattggccaggatcgccgcctcggggatggcttcgagcaggcccaggccgatcatcggcggcgccacgcgggccgagaaacgggtgtcgggatgcatcgggccatagccgagctgggtgatctgcagcttcggtttgcgcagttcgacttcgctgccgtccttgaagcgcacggtcagcggttcgtactcgacccgcaccttgccttccggggcgacaccaggcaccgccatgtcctggaactgcccgccgtacaccggctcgggcacgatgcccagctgctcgatgaccttggcgtaggccggctcattggggatcgacaggcgcaccagcatcgacacggcgttgtccgagtcgggcgtcggcgggtggccgcggccgtccttgatatggcaattctggcagccgttggtgttgaacagcgggcccaggccatcgcgggcggtggtggtcgagggagcgatcacccaggggctgcggaagaaactgttgccgacgctgaagtccaggcgccgggtaggcgacaggttggccgacggcatggaaaaggcgttctggtcgctcttgcgcacggtcgcttcaccgccggaatgtgcttcgcccggctcggcctgggtaaaacgcggggcgtcatcgcaggcactcaggctcaaggccatgaacagcgcagaccagcgaagcagcgacgggggcatcggatatcctgcaggacgagcaaaacaagggcgcaaagtctaacagggcaggggagtttgaataagaggaattatcgttccgcttgacgtgggacaacgcaagcgaagcctgcctgtccctgtcccccggctctggtctggtcctgtagccgctgccgcaggctgcgatcgccaccgcagggggcgcagggtttcaagatcgctgaaggcctgcggccttctcgcagcctgcggcagcggctacaggggacgggtcataggcaggcacaaaaaaaggcgacccgaaggtcgccttttcattcccgcaacagtgatcagaactcgtgatcggcgttgtccgggttcaggtcgctgatgcccagcttgcccgcggcctgttcgatcgaaccggtctgcttgaccagcgcggcgatggtatcacgcacgatctggttgcccgcgtcgttgccggcggcgatcagctggtcgtagtgctcacccttgttggcgtgatcgaccatgacctggatcttggcttcggtggcggccaggtcggccttcagtgcggtgtcggcggccgggtcgattttcgccaccagcgacgacaggctggcgccggtcagcttggtgccgtcgacgcgagtgtattcgcccaggtacacgttgcggatgcccttggcatcgtagaagtgcgagttgtgggtgttgtcgctgaagcagtcctgttcgtcttcaggggagttggcttccagggacaccttcatgcgctcgcccgccagttcgcccagggacaggctgcccatgccgaacagcattttgcgcaggccgctttcagccggttcggcttccagggtggcgcggtagttgtcggccacgttcggcttccagttgccgaccatttcttccaggtcgttgaccagcagttgggtcacggctttcaggtaggcacggcgacggtcgttgtggccgccggtggcgccggcgccttccaggtagtcggaagccggacggttgccggcgccagggccggtgccgttcaggtcctggccccagagcaggaattcgatggcgtggtagccggtggcgacgttggcctcggaaccgcccagctcgttgaggctggcgagtttttccggagtgatgtctttcacgtcgaccttgtcttcgccgacctggacttcagtgttggcgatgatgttggcggtggcgcccgggttacccagcgcgtgctcgtaggacttgtcgacgtagtcgatcaggccttcgtccagcggccaggagttcacctggccttcccagtcgtcgacgatggtgttgccgaagcggaatacttcgctctgcaggtaaggcacgcgagccgcgacccaggcagccttggcggctttcagggtgtcggcgttgggcttggcgaggaaggcgtcgatcgcggtctgcagggtcttcgcggtggattcggcatcgctgtacacggcgaagaccatgtcggcgtaatgcgcgacgaccgccttggccgccgcttcatcgaccttgccggccgcaggagcggtggccggggctgcggtgctggcggctggggtagcggcttgcggcgcggcagcctggtctttgccttcgccgcaaccggcgagggaaatagcgatggccaacagactggcggtagccagaggcatacgaatcatggcgaacatcctgcttcgagagaggggtggagtggcgcgggggacgcgcaaaactgcgacataatgcgaaagatttgcattatgtgtaaagggttgcggttgtaaatatttcctattcagaacgcgattgcgctggatcaggcttatgcgcgcaatcgggtcttcagaagatggccgcgttactgcgctgggcctgtttcaggtaggcgctcagctcccgtgccggcaggggtttgctgtagtggtaaccctgaccttcgtggcagccttcggagatgatgtaggcctcttgctcggcggtttccacgccctcggcgatcacctgcatgcccaggcttttgcccagttggatgatcgcccgcacgatggtcgcatcgtcgtcgtcatccagcaggtcctggacgaagctcttgtcgatcttgatcttgtccagcggcaggctcttgaggtagctcagggacgagtagccggtaccgaagtcgtcgatggcgatcagcgcccccgaacggcgcaggctcaacaggtgctgggcagcggtgctgatgtcttccatcaggccggtttcggtgacttccagctccaggctgcgcggcggcaggcgatagatctgcagcaggttgttgaccacccgcggcagttcggcgtggtgcagttgcacggtggacaggttgaccgccatgcgcaggtcgctgaagcccaggtcatgccattcgcgcagttggcggcaggcctggtccagcacccattcgccgatggcgatgatggtgccgttctgctcggccaggggaatgaacaggtccggcgggacgaagccgtgttccggatgctgccagcgcagcagcgcctcgaccccgaccacccgatgatcgcggtagctgatctgcggctggtagaccaggtggaactgctcgcggctcagggcttcgcgcaggtccttctccagttcgcggcgccggcgcatctcgctgtcgacgctggcgatatagaactgataacgattgcgcgaccggctcttggccagggtcatggtctgctcggctttctgcagcagcttctcggtgctgtcgccgtcttccgggaacagggtgatgccgatggtggcgcgcaggcgaatttcctggtggtcgagggcgaacggtgcttccaggtcgtcgagaatgctctgcgccagttcggcggcttcgtagggttgttcgatatcggcctggaccagggcgaactggtcgccgccaaggcgggcgagggcacccaggcggccactgtgggcccgcaggcgatcggccagggccagcagcaactggtcgccggtctggtagctgaactgttcgttgatgcccttgaagtcgtcgaggccgacacagagcaccgcgacccggcgttgcaggcggccggcgtcgatcaggatcttgtccagttgctgctgcagttgctggcggttgggcaggccggtgaggaagtcgtactgggccatgcgcaacaggctgttttccgcttcatggcgcaggtgcgtgttgcgttcgatcgatgccagcagctggttggcggtattgatccagatccccagctcgtttcgctcgtggcccttgagcaacgggatctgatgttcgctggggcggtccggattgatggtggtcaggtgctcgatgatccgcgacagcggcttggtcagcagccagtggtaaaccaggtacagcaccaggcccatggccagggcgcgcagtacgccggaaatgaaaatgatcaccgagctgacgataaacccctggccgtaggtggccgtgtccagggtgatgctcaggtcgccgtagtattcgctgtagggcccgcgacccaccaattgggtggtgaaggtgcgctccttgccgaggatcagatcggtcagccagcggctgggggagttctgcaactcacgggttttttccgcgagcatggtttcgttgggatggccaatggaggccatgcgcacagcatcgtcctggaacaggccttcgatgacttgcatgcccatttcgcggtccaggctgtagacggcctgggtcgaggggtcgcgaaacatgtcgagaatgcgctgggcatcattagcgaccgcctgccgagtcttataagcatcgaagacgatttgtgcgcagctcagcactacgcccactatcagtgccgacagcagcacaacccggagcaacttcaccgacaagctgtttttgagttccagcttcaaagggttattccttgttccgtgcgggtagcgtcaagttgccatgagtattggcaatcccgtgatggcagtcaaagggacaatcaggcccaggatatttcacctggaggcttggttggaatgccgggagccagcatatccgcgcttatcggttatatgtcggtagccaagccttgcaacttgagggaccgcggcgattttttacctgagcggatgttagcgcgccgggctggcgcggcaagccggccgcttgccggtaaaacgaaaaaacccggcaatgccgggttttttttgactgcaaacgggcttaggcgacgaaggtcttgccttcgaactgctcggccacgaatttccagttgaccaggttccagaacgcttcgacgtatttaggacgcaggttgcgatagtcgatgtagtaagcgtgttcccagacgtcgcaggtcagcagcggggtgtcgccgctggtcagcgggttgccggcgccgatggtgctggccagggccagggaaccgtcagcctttttcaccagccagccccaaccggaaccgaaggtgccgacggaagtcttggtgaattcttctttgaacttgtcgaacgagccgaaagcggcgttgatggcttcagccagagcgccggttggttgaccgccggcgtttggtgccaggcagttccagtagaaagtgtggttccagacctgagcggcgttgttgaagataccgcccgaggaagacttgacgatctcttctagggtcttgccttcgaactcggtgcctggcaccaggttgttcaggttcacgacataggtgttgtggtgcttgtcgtggtggtattccagggtttccttggaaatgtgcggctgcagggcatcgtgtgcgtaaggcagcggcggcaattcgaaagccatgatgattctcctaatcaggtcagttgcggtgagcgcaaggccgatcacgggcggccagacaagcgccggggagtttgtactctttgcggcgcagggttcggatcatagcaccgggggtgcggcttaaccacgcaacaactgtgtgggatagaggttcaaggggatgccctcgctaaatgacgaaacgcgttggcgctgtgatcgtgccaggcaaggcgcgggacgcagaggatgctttttgcctcttcaagtcccgcaacgcagcatggcacgatcacagcgccaacccgaagggccgtcgccccgcaaagcgcaatccgtcgttgttcgtcgctcatttggaccaccaaaccacgctcctcacgcctagtcttgcgctttgcggggcggcggcgcgctcgtcatttagcgagggcatccccttagccttttggaataaatcacccggcggtcatcaactgaaccgcgacgctgaacatcatcaccgccaccagcaggtcgagaatgcgccaggtgctcggccgtgccagccacggagccagccatgcggcgccgagggccagggtgaaaaaccacagcagcgaagcactggccgccccgaccacataggcgccgggttcggtctgttgtgcgcccagcgagccgatcagcagcaccgtgtccaggtacacatgggggttgagcagggtcaccgccagcgcactgagcagcaccgcgcgcagcgagcgcacggtctggttctcgccctgttgcaggctctgcctggaacaggcgcgacgcagggcctggctgccgtaccagatcaggaacacggcgccgccccagcgggcaaccgccagcagtgtcgggctctgcgccagcaccgtggccaggccgaataccccggccgccaccagcaacgcatcgcaggtcacgcacagcacggccaccggcaggtggtgttcacggcgcaggctctgggccaggacaaacgcattctggctgccgatcgccatgatcagcccggccgccaccagcagtccgttaacgtagctctgccacatggtgtttactcctcgcccgccgccagttgccgcagcacgcccatggcgcgctcggcatcggccttaccgacaaacagatgatcgtggtagtagccggcgatcacgttgcagctgatcccggccttgcccagggcgctggcgaacgcggcggtcaggccgacggcttccagggccgaatgcacgttcagggtgatccaggccgcgacgtaatcgaaacccagccccagccgctcggcctgctggcgctcgaggatcaccgtgagtccttcctgctcgcgaaagctgcccagtacgtcggtgccttcgagcagcgcgcgatcggcgatggagcagaacacgtagtcgccgtggttgagctgcgggctcatgctgcgcagcagggtatcgagggaggtttcgccagccatgaaaaaggtccttgaacgagaaagcatgctggctattctccggttgcaggctgtataagaaaaaccaatattactgatcgctcattaggaaaactgatgttcgactataagttgctgtccgccctggccgcggtgatcgaacaggccggattcgagcgtgccgcgcaggtgctggggttgtcgcagtcggccatttcccagcggatcaagctgctcgaagcgcggatcggccagccggtgctggtgcgggtcacgccgccggcgccgacggaaatcggccggcgcctgctcaaccatgtgcagcaggtacgcctgctcgagcgcgacctgcagagccaggtgccggccctggacgaggaaggtttgccggagcgtctgcgcattgccctcaacgccgatagcctggccacctggtgggccgaggcggtgggcgacttctgtgccgagcagcacttgctcctcgacctgatcgtcgaagaccagaccgtgggcctcaagcgcatgcgcgccggcgaagtggcggcctgtgtctgtgccagcgagcggccggtggcgggcgcccgcagcgtgctgctgggcgccatgcgctaccgtgccctggccagcccggtcttccttgcgcggcattttccgcagggtgtgcaagccgagcgcctggcccgcacgccagccctggtgttcggcccggacgatttcctgcagcaccgctacctggcggcgctgggggtcgatggcgggttcgagcatcacctgtgtccctcgtccgaggggttcatccgcctgaccgaggccggcctgggctgggggctggtgcccgaattgcaggtgcgcgaccagttggcgcggggtgtgttggtggagcttttgccagataagccgatcgatgtgccgctgtactggcatcattggcgcaatggtggccaactgctgggcctgctcaccgagcacctggcgcgttcttcggcgcaatggctggtgccgttggcgtgacaccaggcgtcaaggcatcaggcaatagcgttaagcaatacatagtgcgacaggcatgaaacacgaaagcaatcggagcaagtcatgaaaattctggtcaccggcgcaagcggcttcattggtggacgcttcgcgcgttttgcccttgagcagggcctggatgtacgggtcaacgggcgtcgggccgaaggagtggaacatctggtgcggcgcggggccgagttcgtccagggcgacttgagcgacgcggacctggtgcgcgacctgtgtcgcgacgtcgacgcggtggtgcattgcgcgggggcggtggggctctgggggcgctatcaggattttcatcagggcaacgtgctggtcaccgaaaatgtggtcgaggcctgcctcaagcgccatgtccggcgcctggtgcatctgtcgtcgccgtcgatctatttcgacggtcgcgaccatctgggcctgaccgaggagcaggtgcccaagcgcttcaagcacccttatgccgccaccaaatacctggcggagcagaaggtgttcggcgcccaggagttcggcctggaggtgctggcgctgcgcccgcgctttgtcaccggcgccggcgacatgagcattttcccgcgcctgttgaagatgcagcgcaagggccgcctggcgatcatcggcaacggcctgaacaaggtcgatttcaccagtgtgcagaacctcaacgaagcgctgctcagcggtctgctggccagcggctcggccctgggcaaggcctacaacatcagtaacggcgcgcccgtgccgttgtgggacgtggtgaactacgtgatgcgccagatgggcgtgccgcaggtcacgcgctaccgctcctttggcctggcctacagcgtggcggccctcaatgaaggcttctgcaagctctggccggggcgtccggagccgaccctgtcgcgcctgggcatgcaggtgatgaacaagaacttcaccctggatatcagccgcgcccgccattatctggattacgaacctaaggtcagcctgtggacggccctggatgaattctgcggctggtggaaggcccaggacatacgctgaaaataaacactgaaccgagttcggggttcagggtcgatcagggcggcgggttagcggtttatactcgccgcattcagctatcaccgcggttttagaaaggttgccccatgcgtaacgatgccaacgacgacttcgacgatgttccaagcctgcgtgccgataccctcgacgatgatttcccgaccaccgccgcgggccgcgcgcgtacttcggtgcattcgcgcagcgtgccggcagccaaggtcaaggcaccgagtgccgggccgctgtgggcgctggtcggcgccttgttcttcgcctttatcggcctggcctggtggagcttccagcagatctcgctgatggagcagcaactggtcgccacccaggagagtttcgcccgcatcagcgaagaagcggcggggcgcctgcaggatatttccggcaaggtggtggccagccagtccagcgtcaacagcgacagcgaagccttgaagctgcagatcaagcagctggaaagccgcctgcaggaccagggcaagcagcagcaaggcgtggccgggcaggccacggacctggacaagcgcctggcccagatgaccgcgcaagccaccgagcagcaggcggccaatacccagttgcaggcacaggtgaaaaccttgggcagcgaactggccgccctgaaaagcgcacctgccgacaccagcaaggtcgatgcccagttcaagagcctgagcgccgagatcgccgccttgaagaaacagggcaacccgagcgccgccatcgagcgtctggagcaggacatcatcgtgctcaagagccagcaggacaatcgtcccgccgcggcccagggcggcaccaacaccgccgagttcgacgctttccgcggccaggtcactcgcaacatcaataccctgcagagccagatccagaatctgcagcagcagctcaatacccgtccctgaccctggcgaccttcccgcgcgtggcgtgggaaggtcgcggttttgcctctcgcctccctgcttcgctgaatactcgaccatatcccgcagccgtctacgctcttgaaacaccaacaagaacgagggatgcgcaatgaggggattgcttagagccacggtgctgggagggttgctgatgttctgcgccagccaggtccaggcggcggacgatgccacggcggccaaggccctgctggagaaggccctggcctattaccacgaccacggtgacaaggccttcgccgcgttcagccggcagggcgagttcgtcgacaaggaccgttatgtgtttgtggtcgacacccagggggtgatgctggccagtggcgggccgtcgtcggcgctgatcggccgcgatgtttccgaggtgctcgggccggatctgcaaaaggccttcaaggacgcgctgaagattcccgagggcaatggcatccagcaagccgaataccgctggcagaactgggccgacggcaaggtcgagcgcaagcatgtgtattaccagcgggtcggcgagcggatcctggcggtcggctattacctgccacgggcttccgccgagcaggccaaagccttgctggacaaggcggccaccgaactggtcaaggacgagaagggcacgctgacagcgatcaactcgctcaagggcggtttcctgcaggacgacctgtatgtgtttgtggtcgacctggacaaccagcgctacgtggcccacggcaccaatctgcggttgatcaataccgacttcggcaaggtcaaggacccggacggcaaaccggtgggcgagccgatcctggcgctgatggccacccaggatcagggcgagtatgagtaccgctggaagaacccggtgacggccaaggtggaagacaagcacgcctacctgcgcaaggtcgggcacttcctggtggcggtggggtactacagcccgtgacggtcggtcgccagccagctcgcctgtagcagagctggctggtgatgccgttatttgaccttgtcttcgcgcccgcgcagcagcgcgttgggcatggccagcgccgccgccaagccgagcaatgacaccgccgcactgaccatcagcaagtgtttgaaggtcagcagcaactcagcccgcaaggctccctgttccggacccggcgcggcgttcaggccgtcgagcagcacattgcccgagtggccttcgccgatcagcgccgagccgctcaattgggcgaagctggaatcctgcaacagcgccagcaacagcgccgacatcaaggccacgcctaccgcaccgcccagggagcggaacaggttggtggtgctggtggcgaccccgatgtcccgttgttccaccgagttctggctgcccaccagcgacgtcgggaactgcatgccggaggcaatcccgctgaacaacatgaacacactgctcagcagcaccgcctggggcgggctgaaggccatgccgagaacggtcagcggcatcagcagggcgccaccgaggatcatcggtttgtagcgaccggtcaccgaggtcatgcgcccggcgaagtaggcgcccatcggcaggccgatggccagcggcagcaggtgcaaggcggcgctgtcggcaccggcgccggtgacgctctgaaagcgcaacggcatcagcaccgtcagcgagatggcctggaagctggtgaagaacaccgtgcaccagcacaacatggcgttgcgattggcgaacaggtgcatgggcagcagcggctcttgcgtgcgccgttcatgccaggcgaacagggccagggcgacgacggcacatgccagcaggcccagtacttcgttgctgcgccaggcgtgaccctggccgaaatgggtgatcgccagcagcagggccgtcaggccgatgatcatcagcagcgtgccgaggtagtcgatgatcggtttgcgctgcggaatcggcagcccccgcaggttgcgccgggccaccagccaggcgcccaggcccaggggcaggttgatcaggaacacccagcgccaggacaggtattcggtcatgtagccgccgagcaccgggccggcgacgctggccgccgcgtacatgctgctgaaatagccctggtaacgcccgcgctcgcggggcggcacgatgtcgccgatgatcgcctggctgaccgaaatcatcccgccggcgccgatgccctggaagatccgcgccagcaccagctgttccatgttctgcgccatgccgcagaacagcgacgccagggtgaacaggcccatgccgaacagcatcagcttgcgccgcccgtagaggtcgccgagcttgccgtagatcggcaccgacacggtcatggccaccatgtagccggagatcacccaggccatcaggctgacatccttgaattgcgcggagatggcgggcatggagaccgcgactatggtctggtccagggcgccgaggaagatcgccagcatcagggcgatcagtacgctgcgaagagccaattggggttggccaggctggttgggatgggtcacgaaagaacctgcgggcagtgattgacccgcagggtgcaaggcgagcgggaatgctcgccagtgtactcgataggctcctactcgatagcctcgtaaggaaggccgacgtaattttccgcgatggttttacgcccggcctcggagtcgacgaagtacgccagctccgactcggcgatgcgctggctgaagtcgtcggagtcggggaaacggtgcagcatcgcggtcatccaccaggagaaacgctcggccttccagatccgccgcaggcagatttgcgaatacttctgcagcaggtcggtgcgttgctcgcggtagaccttgagcaggatgttgaacagcgtgctgacatcgctggcggccaggttcaggcccttggccccggttgggggcactatgtgcgcggcgtcgccgaccaggaacagccgcccgtattgcatcggctcgaccacgaagctgcgcagcggcgcgatgcttttctcgatcgacggcccggtcaccaggcgctcggccagctcctcgggcaggcgcttcttgagctcgtcccagaagcgttgatcggaccagtcggcgacattttcctctgccggtacttgcaggtagtagcgggtgcgggtggtcgaccgcatgctgcacagggcaaagccgcgttcgtggcgggcgtagaccagttcgtcgtggaccggtggggtgtcggcgagaatgccgagccagccgaacggatagacgcgttcgaacaccttgagcttgtcggccgggatcgactgccgggcgaccccgtggaaaccgtcgcagccggcgatgtagtcgcagtccaggcgatggggttcgccctggtaatcgaaggtcaggtagggctggtcgctgtgcatgtcgtggggacgcacgttgtcggcctggtacagggtccgggcgccgacggcctggcgggcctgcatcaggtcgcgggtgacttcggtctggccgtagatcgtgacgctcttgccgccagtgagggcgtgcaggtcgatggccacccggcggccgtcgagggccagttcgaagccaccgtgcaccaggccttcggcgtccatgcgctggctgactccggcctggcgcagcaggtcgaccatgccttgttccagcaccccggcgcggatgcgcccgagtacgtaatccggggtttgtcgttcgaggatcagggtatcgatgccggccttgtgcagcagttggccaagcaggagtccggaggggccggcgccaatgatggcgacttgagttttcagggttttcattgtttttatgactcgcaagcttcacacgaacaggttcgctgactgatttttatgtttcgagtgcctgcatttttcacttgtgatgctgtcagttgaaggtgaaaactgagccgatacctgttcatttcaccaattggtgcgattatcgcccgtcacccagaggcctggattgcagttatgaataagcctgccttgccttcaattccggtgttcaaactctatggggaaagcctggattggccgacaccggacctgctgcactgcgaaaccatttccaagcgcagccgcgagcaccattgggaaatcaagccgcatcggcatgccgatctctgtcagttgctgttcgtgcatcgcggccaggccgagcttgagatcgaaggccagcgcacgctgctgggagagtcggcgctacagatcctgccggccctgtcggtgcacggctttcgtttttccgaagacatcgacggttatgtggtgaccctggcggcgcccttgatggcccatctgcaagctctgctggggcattcggtaaatgccctggccgtggccgagagctacccggcgggcgctgacggcgactacctgaacagcctgtttgccgcgttgcagaacgagtaccagggacgtgagccggcgcgggaaatgctcatgcactcgttggtcagcgtgatcatggtgtgggtcagccgccaggcgatccggcgccgcagcgccagccagcgaccgcagcgggcacgggagtatttcaatgggtatatccaactggtggaggcccactatcgcgagcatgtgaaggtcgaggacctggcgcacaagctggggatttccgtttcccacctcaatggcacctgccgtgaactggcgggccagccggccctgcagatcatgcatgagcgtcagctgctggaggccaagcgcctgctgacctacaccagcatgaccatctacgagatttccgacaccctggggttttccgatcccaccaacttcacccggctgttccgccgccgagtcgggatctcgcccaaggctttccgcgaccggctgaagaccgatcacgaacagtgacgctgcgcgtctgcatcatttcagggagttgagagtcgcggtgtgcgggatgcactggtcgacgttgcaactggcgtagacacggggctgttgccgggcctgttcgacgcgataggccgctgttccatacagcgccagggtcgcggtgcaggtgacgaaaatggccaggtatcttcttgttttgatgttcatggcaaacacctctgaacgaatacccctgcgcgtgtgggggtactgttatcagcatagatcagccattgggatcagccatggccgccggccaggtcgcgggcagcgtgttgacggggtattcagcggtcttatcgggctttaaaggcccttgtcccactccggctcctcggggaaacgcagcaccaggaaatccagcatgctgcgcagggccgccggcatgtgtttgcgcgaggcgtagaccgcgtacatgttcatttgccggggctctgcgtggggtagcaggcgcaccagttcgccgctgtggatatgcaccccggccaggaagctgggcagcatggccacgccggccccgaccatggtcgcgcgcaacagggtgctggcttcgttggcgctgatattgccctgcaccgggaccgaaacctgttcgccgtcctgctcgaaatgccacaggctcttgccgaaataggagtgggtcaggcagttgtgctggctgagttcctcgacgcgttgcggcgccgggtgctcacgcaggtaggccggggaggcgcagatcaccgagcggcagaccgtcagccgccgggcgatcaggttcgggtccaggtcgttgctggtgcggatcgccaggtcgatgcgctcgtccaccaggttcaccgtgcggtcgagcatctgcaggtcgatgctgacgccggggtaacgcttgacgtaggtggccatggcatcggccagctgggcctggccgaacgaggtgctgacgctgatgcgcagcaagccgcggggcgcgtcgtcgggttcgctgatggcggcctgcatgtccgtcgacaactcgagcatctgccggcagcggggcaggatctccgtgcccgccgcagtcaggctcagcttgcgggtggtgcggtgcatcagccgggcgccgacccagtcctccagttccgccagatagcgcgaaaccaccggccgcgagaggtccaggtggtcggcggcggccgactggctgccgagatcgactacggtgacgaagacgcgcattgcttgaagacgatccatgatttgcccgctttcagaaacaaactatgtccaagcatcgcattttttgtaacgagtgcggcaactaagcttcatccccatcgcctacccctggccacttacggccgacagaccatcggagctgcacatgatcggattcacctcactcaagcgcctgctgctggcgaccgctaccctgggtttcgccgcccatgccgccgccgtcgagccggccctgagcctggatgtgtacaacccgggcgccgcggcgatcttcccggtgacctcggtgctggtcagcggcaagaaggaagcgatcctggtggatgcgcagttcggcaaatcccaggccgagcaactggtggaaaagatccgcgccagcggcaagcagctgaccaccatctacatcagccacggtgacccggactactacttcggcctggacaccatcacccgggccttccccaaggccaaggtcgtggcttcgcagccgaccgtcgagcacatcaaggccacggtcgacggcaagctcgcattctggggcccgaaaatgggcgccgacgtgccggccaagaccatcgtgccgggcgtgctcaagggccgcagcctgagcctggaagggcagaagctggacatcatcggcctggacggcaagcaacctgaccgtaccttcgtctggatcccgtcgatcaaggcggtcgtcggtggcgtggtggtcgcggaaaacatccatgtgtggatggccgacacccagaccgcgcaatcccacaaggattggctgaccacactggacaccatcgccgcgctgaaaccccagaccgtggtgcccggccattaccttggcgaaagcgcccgctccctggctgccgtgcatttcaccgccgactacatcaaggccttcgatgaagaaaccgccaaggccaaggattccgccgaactgatcacggcaatgaaaaaacgttacccggacctgggcgaagacagctccctggagctgagcgccaaggttgccaagggcgaaatgaagtggtgattcgaccgtccccgcgcccggcgcgggggcattccctgtatggctttgtatcacttgtcgaaactggagaactgtcatgagcaagatcgcaatcattggggccaccggccgtgccggtagccaactgctggaagaagccctgcgtcgtggtcacagcgttaccgcgattgcccgtaacccggcgaaaatcggcaatcgcgccggtgtggtgagcaaggcggtcgacgtgctggacggcgcggcgttgcaagcggcgatcgccggtcacgatgcggtgatcagtgcggcgcacttttccaccatcgcgcccaaggccgtgatcgagccggtgaaaaaggctggggtcaaacgcttgctggtggtgggcggtgccggttcgttgctgctgcccgacggcagccgggtgatcgatgccgccggttttccggacgaatacaaggccgaagccagtgccggcagtgtgttcctcgataccctgcgccaggaacaagagctggactggaccttcctgtcgccatcggcggagttcgtcgaaggcgagcgccgcgggcagttccgcctgggccaggaccatctgctggtgagcgccgaaggcaagagctggatcaccttcgccgactacgccatcgccatgatcgatgagctggaaacaccgaagcattcccgccagcgtttcacggtcggttactgagcctgtagccgctgccgaaggctgcgatcggctgcgcagcagtcgtaaaaccagacatcgcgtttttgcaggtacaacgtgttgactggattatgaccgctacgcgttcgatcgcaggctgcgccagcggctacagggttacagcggctacagggctatcgtgcgcgggcctgttccaccagccagtccagcaacgcccgtaactgcggcgacggtgccgagcgatcggggtgcaccaggtaataacccagccccgtacggaccttcagttcaaatggcatgaccagccgcccggcgctcaggtcttcgccgatcaatgcccaatcgccaatggccactcccgtcccctgggaggcgaccgacatcgccaggtccagggtttcgaaatgctggcccttgccgatgttgttcagcgccgtccccgaggctttcagccaggtgttccagtcatgggtatccagggtcgggtgcagcagcatgtgttgctgcaggtcggccggggtctggagcggtatcgccccttcgagcaatgcaggtgaacacaccggcgtcagctgttcgtcgaacaggtgataggcgccgagggtggaaggtggcggggcaccgtaaatcaccgcggcgtcgaactgctcgcggctgaagtccaccccgtgctgcaccgtggtggtcagccggacaggcacgtccggacgctctttctgccattgcatcaggcgtggcaacaaccagcgcatcacgcaggtggacgccttgagttgcagggtgtcgcggttcaccccgacctgttccaccccctcgctgatcaggccgaacacctgttccacccgtggcagccattcccgtccttcggccgtcaggctcaggccgcgggcctggcgctggaacaaggcataacccaggtgactctccaggccggcgatctgccggctcaccgcaccctgggtgatatgcaactgctcggccgcgtgggtgaagttgcagcagcgcgcggtgatcagaaaggtgtgcagcgcgggtaggggcgggaggcgtttcataaagggccaaggcatgacgtgaggacatggcgagtatgactttttatccattgttcccgctacacgtggcccgttccaatgacgccttccccgtgcctggccatgcagcggccagccaggcataccgtctcaagcgaacaaaaagggcaagacatggcgacgtgcggcgaagtgttggtcaagttactcgaaggttatggcgtcgagcaggtcttcggcattcccggggtgcacaccgtcgagttgtatcgcggcctggcccgttcgagcatccggcatgtcacgccgcgccacgagcagggcgccggcttcatggccgacggctatgcccgcaccagtggcaagccgggggtgtgcttcatcatcaccggcccgggaatgaccaacatcaccacagccatgggccaggcctatgccgactcgattccgatgctggtgatctccagcgtgcaatcgcgcagccagctcggcggcggccgcggcaagctgcatgaactgccgaaccagggcgccctggtgggcggcgtggcggcgttctcccataccctgatgtccgcggcggaactgccgggtgtgctggcccgcgccttcgcgttgttccaggctggtcgcccgcgcccggtgcacatcgaaatccccctcgacgtgctggtggaggaggccgacgacctgctcgacagcgagccggtgagcatcgcccgggccggcgccgcgcccgccgccatcgcgcggatgagccagctgctggcgggcgccaggcgtccgctgatcctcgccggcggtggcgcgatcgatgccgccgcgtccctgacccgcctcgccgaatggctccaggcgcccgtggccctgaccatcaatgccaagggcatgctgccgtcccggcacccgttgctgatcggttcgacccagtcgctggtggcgacccgtgccctggtggccgatgccgacgtggtcctggccatcggcaccgagctggccgaaaccgattacgacgtgactttcgccggcggtttcgagattcctggcgccttgctgcgcatcgacatcgaccctgaccagaccgtgcgcaactatccgccgaaagtggcgctggtggccgacgcgcacagcgcaaccgaagccttgctggccgagctgggcaaacaaccgctgagcgagcgcgacagcgcctggggcgcggcccgtgccgctgccctgcgtagtgcactggagcagcagtgggacgcgccgacccgggcgcagaccctgttcctcgaaaccgtcctgcaggagctgccgcagatcgtcatcgtcggcgactccacgcagccggtgtacagcggcaacctgaccttcaaccccgagcgtccgcgccgctggttcaactcctcgaccggctacggcaccttgggttatgccttgccggcggcgatcggcgcctggctcggtggcgcttccgaacgcaacgcccggggcccggtggcgtgcctgatcggcgacggcggcctgcagttcaccctgtcggaactggcctgcgcggtggaagcgcgcgcaccaatcatcgtgctgctgtggaataaccagggctatgaagagatcaagaaatacatggtcaaccgcgacatcgagccggtgggcgtggacatctacacgccggacttcatcggcgtggccaaggccctgggctgcgccgccgaggccatcgacagcgtcgacggattgcgcgatgcgttgcgcgcggccagcgatcgccagggcccgaccctgatcgaaattgaccaggccggctggatgcgggcggtgcaggcatgaacccggcaaacctgctgaacggtctttacatcgatggccagtggcatgccggcagcgcgctgttgccggtgatcaatccgtctaccgaagagccactggccgtggtcggtggcggcgacccacacagcgtcgagcaggcggtgagtgccgcccaggccgggctcgccgcgtgggctgcgacctgcggcgccgagcgtggcgcggtgttgcggcggatcgccgccggtgtcgccgagcgtcgtgaacgcctgatgcacctgcagtcgagcaacaacggcaagccgcaattcgaagcggccatcgacgtcgacgacgtgattgccaccttcgagtactacgcggggctggccgaaggcctggacgccacccaggaccgcgatgtgtcgctgcccagcgatgatttcagtgcccgtgtgcggcgtgagccctgtggcgtggtcggcctgatcgtgccgtggaacttcccgatggtcaccaccgcctggaagcttgcgccggccctggccgccggttgcagcgtggtgctcaaaccctcggaagtcacgccgctgccggaactggagctggcggcgatcatcgccgggagcggcttgcccaagggcgtgttcaacctggtctgcggcaccggcctggcggtgggcgcgccgctggcggccgatccgcgggtggcgaagatttcctttaccggcagcaatgcggtcggggtccaggtcatgcagcgtgctgcggagacggtcaagggcgtgagcctggaactgggtggcaaatcttcgctgctggtgctggccgatgccgatctcgaactggcggtggagctggcctgcggcggcggttttttcaacgccgggcagatgtgctccgccaccagccgggtgctggtggccgacgaactggcggacgaattcctcctgcgcctcaaggcacgggccgaggcgattcgggtggcggaccctttcgatccggacgtggagatgggcgcgctggtcaaccaggcgcaataccagcgtgtgctgggccatatcgatcgcgggttgagtgtcggggccaagttggtatgcggtggcgagcgcccggcggaccgtgcgcgcggcttttttgtgcggccgacgatcttcaccgaagtgcccctcgacagtgcgctgtggcgtgaggagatctttggcccggtgctctgcgtgcgcagtttcgccagcgaggccgaggccatcgcgctggccaacgacagcgaattcggcctggtggccagtgtggtcggcgccgatgtgcagaacgccgagcgagtcgccaatgccttgcaggccgggctggtgtggatcaacgcaccgcaggtgatcttcccgcagacagcctggggcggctacaagcagagcagtatcggccgcgagctggggccttggggtttgcaggcgttccaggagatcaagcacgtggttcgcgcgcggtaacagtcttttggagcgagatggtttctgtaggagcgagcttgctcgcgatgcgggtcaaggatgacgccgtgcgacagatagagcgccgccttgcggctatcgcgagcaagctcgctcctacaagggggaatcagacgctgctgcgcaggcgcgccatgtcgcgcagcggcggggcgccgaactggcggctgtattcgcggctgaactgcgaggggctttcgtagccgacccggtaaccggcggcggacgcctccagcccctcagtcagcatcaggcgccgggcttcctgcaggcgcagttgcttctgatactgcaaggggctcatggcggtcatggccttgaaacggtggtgtagggtggacacgctgaggttcacccctcgcgccagatcgtcgatgcgcagcggttgctcgtagttgccgttcagccatttgatggcctggctgacccggtggctctggctattggcgatggcgatctcatacaaccggtggccctgtgggctgcgcaacagccggtagagaatttcccgacgaatcagcggcgcgagcatggcgatgtctttgggcgtgtccagcaggcgggtcaggcgcagcacggcgtcgagcatcggcgtgtccaggcgttccacatacaggccgcggccgacagaacggttcggcacccccaacggcccggcatcggcgatcagcgtgctgatttcggccgggtcgatgtccaggcgcagggccaggaccggttccagcggcgagacatcggccaggcgcccgctcaatggcatggaaaccgagaccaccaggtagttgagcgggtcgtagttgaactcctcgtcggccagccgcacttccttgcgcccctgggccatgatgcacagggccggctgggccagcaccgaggcgaaatcgtgggagtggctgtggcgcgagacgaacagcgactggatcgccgtggcatagctgccgtcttcgccggtattgcgagcaatgatcccggccagctccgcccgctgtttttccatctccgcatccagtggcggctgctgggtttcgagcgatgacatgaaggcccctccgggaagattgcgaatggccacagcttaaatttgtgcaagcgccaggggtaggcgattcctgcgtaaatcttgcctgatcctgccacgcgtgcgcgcgtgagtagagccgactcctgtgcgcgggttgtcacttgcttgaaacaacgttgtgggttttttccgcttaccgggcaggattcggcgttcccgggcaagactcgcaggattgtgcaataggccggcaggaatcgactaacgagcattacgtcgggcgcttaatcttggatcctgtcgcagcccgtcccatggctgcctcgacaccaccctgggagggtcgcacatgtccacgcatattcccgtcagccatatggcattcgttcgcgcccgcgccggccgctcaacggagttgggtgctcgcttgagcagtctgatcgaaccatcccgccaggccacaggttgcctgcagttcgccttgcagcattcgcagtgcgacgctgacctgtggctgatatccggattctggagcagccagcaggcgatgaccgattacttctgttcgccggccatggcgatcttcgccgagctggtccaggacctggtggtcaacagcctggatttccatactttcagagacgtctcggcggcccaggccgaaggcgaatacgcgcaactgaacggggcaccggtacaccagctggccagctgagggtttagaatggccgactttccattggccaggaccagcaacatggcacgtaaagagtttgcagcatacgaagcggtttccgccgtggttccaggtgaagggggctacagcgccgccatcgcggtcaaggccctgggtggttcaggggcaccgcgctttcacaaggtcctcgacgaccagaaattcaagaccgcccatgacgccgaccaggctgccgcgcagaagcttgagcagttgatcgacgtgaccgaagacggcgaactggcctgggaaatggcctgatccgggtcgctacctgatctgagcagctagttggattgagccgctacctgaccgcccccgggcggaacatcttgaacaaggcctctggccccagctggaaataatccgccggcccgccgccgcgcagaatcggctctgccgcggcggtgtcgtataccccatccttgagcagccacttggcgatatgcacggcgaccacttcgccgaggatcagccagctgggcaccaactcctgatccgcgcgctgcaattgaatgatctgcgtgaccttgcactcgaaggacaccgggctttcggccacccgcggcaccgcaatcactttcgaggccatgggcgtcagccccgccagttcgaactcattgacctcggccggcacggccgcgcagctctggttcatccgctcggcgagcgggcgggtggcgaggttccaggcgaactcgccggtctgctcgatgttgttcaggctgtctttgcgaccgacgcttgcgaaaccgatgatcggtggaatgtaattgaaggcgttgaaaaaactgtagggcgccaggttcagccggccttgctggtcctgggaggagatccagccgatcgggcgcgggccgacgatggcgttgaacggatcgtggggcaggccgtggccctgggcgggttcgtagtaatggatgtcttcggacatggcaggctcttgcgcggacaaagagggaaggccgccatagtgcaagccattgaacgtgaataccagccttgcgccgtgcggttttccccgggccagaaacaactaagcccggccgaagccgggctacggggcatccctgagggttagccgatggcggcggcagtcccggtgcgatcgaagccgtcggcagcgattgcgcctgcggtaccggtatggtcgaagccgtcggcagcgattgcgtcagcggtgccggtgtggtcgaaaccgtcggaagcgactgcgcctgcggtgccggtgtgatcgaagccatcggaggcgatagcggcggcggtgccggtgcgatcgaaaccgtcggaagccaggctggcgctggccgagctgcccgaggtgaaagtggccgagccggtgcggtcgtaaccatcggcggcaaaggtattggcagccagtacggaaagggtcagggcgaggatcagtttgcttttcatgagggtcactccaggttcgttgacgttgtgtgcagtgggtgtgaaatggatactacgccagttaatttgattaaaaatcgcaaatgaatgctgaaaaatatcgaattaatagatgtttttggcgtcaagaatcgctgcataaagcctctttcctgcttctgccgcgtttgaggcgccgacaccgatttcgatggaggcagagtgagggctgggcattaaccggtcattaacctgtccgcaccgtcgagaaatcacgatcaacggtttcccggcaggggcgggaaggctgttggcgatgaatgccggagggcttgctacgtgagctggagggcgggccttgatcgtggagcggctgcgttgcggctatcgcggggcaagtcggatgctcgctcctacagaagcacgcttgctcgcgatgggatctgacgacagcgcgagggccttgcaccctcgcgctttttttgtcggtcagtcagtctcgatccgcgagtgtttgcgcgtgtctttcatggtgatgtagaccagcagcgacacggcgatgcaggcggtgacataccagtagtaaccggtttccatgccgacgctcttgaaccacagcgcgatgtattcggcggtgccgccgaagatcgatacggtcagcgcgtagggcaggcccacgcccagggcgcggatctcggtcgggaacagctcggccttgaccaccgcgttgatcgaggtgtagccgctgacgatgatcagcgccgccatgatcaggaagaacgcgccccaccagctctggatggtgtgcagggtggtgaggatcggcacggtgaaaagggtaccgaggatgccgaaggcgatcaggatcggacggcggccgatcttgtccgacagcgcgccgaccaccggctgcaggcacatgaacaggaacagggtcgccgcggaaatggtggtggagtcggagatgctcatgccgacggtgttcaccaggtatttctgcatgtaggtggtgtaggtgtagaaggccagggtgccgcccatggtcaggccgaccacggtcatcaactcttttggatgacgcatcagggtgcgcatcaggctttctttcggcttttccttcttcttggtgaaggactcggtttcttccatgccgcgacgcaggtacagcgcgacgatcgcgcacagggcgccgatgccgaacggaatgcgccagccccaggattgcagctcctcggtggtcagcacgttctgcagcacgatcagcaccgccagggcgatgagctggccggagatcagggtcacgtactggaagctggagaagaagccacgacgttccttggtcgccatctcgctgaggtaggtggccgaggtgccatattcgccgccgaccgacaggccctgcatcaggcgcgccagcaccagcaggatcggagcgccgacgccgatggtctcgtagccgggagtcagggcgatgatcagggagccgaagcacatcagcagcaccgaggccatcaatgcggccttgcggcccttgcggtcagcgtagagccccatcagccagccgccgatcggacgcatcaggaagcccacggcgaagatcgcggcggtgttcagcagttgcgcggtggtgtcgcccttggggaagaagactttggcgaagtacagggagaaggcggcgtagacgtaccagtcgtaccactcgaccatgttgccgaccgaaccgctgaagatcgatttcaggcggctggcggtggtcttttctttggcaggcgcagctgccgacccaagaggcagggtttgcgagttatccatgacggatccttcatttaattgtttttgtggagcgcgccgaaacgcagcctgctggagctatagcaggagctgtgccaggagctgaaaggcctggtttagaagggtcttgagattgcaatgagcggaaatccgctcattggcgaaagtgcgtgagcggaaaattgccgatgaaggtggtgttggtgagggcgtcttcgcgagcaagctcgctcctacagaagctacgtgatccctgtaggagcgagcttgctcgcgataggacctcgggcatcactcctccccaagaaacatctcccgcgccagcccatggcgctgcatcttttcattgaaggtgcggcgcggcagttgcagctcgacgagcaccgccttgatgtcgcccttgtgccgggtcagcgcggcccgcaggcattgcgcctcgaaagcttcctgctgcgccgccagggactggccggggtcgatggtttccggctcgggctcgcccaggccgagcacctggcgttcggcgacattggccagttcgcgcacgttgcccggccagtcgtggctcagcaggcggctcaactgcgccccgctcaggggcgcgacgctacggcccaggcgctcggcggcggcgtgggcgaaatgttcgtacagcagcggaatgtcttcgcgtcgatcccgcagcggcggcaggcgcagctgcgcgacgttcaggcggtaggccaggtcttcgcgaaagcgcccggcgcgggcttcgtccagcaggtccggcttggtcgcggcaatgatccgcaggtccacctcgatgctttggttggaacccagtcgctcgagcttctgttcctgcagcacccgcagcagcttgacctgctgggccagtggcatgctttcgatctcgtcgaggaacagggtgccgccgtcggcgtattccagcttgccgatgcgcttgccctgggcgccggtaaaggcgccgctttcatggccgaacagctcggcttcgaacagttgctcggggatcgccgcgcagttcagggcgacaaagggcttgtcggcgcgcggcccgaagtcgtgcaggcagcgggcgaccagttccttgccgctgccggtctcgccgcggatcagcacgttgaccggcagcgcggccaggtcgaccacctggcgccgcagggtctgcaaggcgcgggatacaccgagcagggtggagtcgattttctcccgggtatcggcctgttcgtgcaggcgccggttttccaggaccaggccgcgcttgtccagggcccggcgcaggctgctcaacagggtttccgggctgaagggtttttccaggaagtcataggcaccgtcgcgcatcgcttccaccgccatcggcacgtcgccgtggccggtcagcaggatcaccggcaggtcggcgtcgcgttgctgcacctctttgagcaattccaggccgctgatgccgggcatgcgcacgtcgctgaggattaccccggggaagtccctgggcaaccgggccaggcagtcctcggcgcgactgaacagctgcacctcgaagcccgacaggctcagccattgttcgacggcggtgcgaatactggcttcgtcgtcgaccagcatcaccgaattcaacatgggatatgcgcctccaggtcgatgggcaggctcagggtgaagatcgcgccctggccctggttgccggcgctcaggcgtccaccgagttcgtggacgatagcgtaggacaccgccaggccgaggcccaggccgtcgcccaccggcttggtggtgaagaacggatcgaagacgttcggcaggtgttcttcggcgatgccgccaccgctgtcgatgacgctcaggctccacagctgctggtcggcttcgaggcggatttccaggtgcttgaggggcttgtcgcgcatggcgtccagggcgttgcgcagcaggttgatcagcacctgctccaggcgtatggcatcgccgcggacccaggccgggcgcgtcagttgcaggcgtgtgtcgacctgttcgtcgcgcagccgggtgtccagcagttgcagggcctgatccaccaccgccgccaggtccaagcgttcgcgcaggccgctggggcttttgcgggcgaaggttttcaggtggccggtgaggctggccatgcgggtcagcatatcgtccagcggtttcagggcctgataggcctcgtcgatccgcccgtgatcgagcagcaggcgcagggtggccagttgcatgcgctgggtggtcagcggttggttgatttcatgggccagggccgcggacatctgccccagggccgccagcttggccgattgcaccaggccgtcctgggcggtgcgcagatcgcgagtgcgctcctcgaccaggcgttcgagctcttcgcggctgcgctggcgcagcctggccaggcgccagcgctggttgaggaacagcagcaggaacaccagggtcagccaggcaccggccgcggccaggccggcattgcggcggtcctcaaaggcgatctgcggacggcgcaacaggtgcagggtccagccttcggtggccaggggcagggattcccacaggtagtcgacgctgccgtccgggccctcgacccgggtcagcgcgctgtcgtcgtcaaagcgtcgcagcggccgatgttcgagcggggtcagccgttgcttgtcgtattgccgggtggcctggagttcggcgcggtcgctgtccgacaacgggcgcagctggcgataacgccagcccggctggttggcgatgaacacgatgccccgggcatcgctgaccaacagagtgtcgctgccctggctccactcgcgctccagttcggggaactccagtttcaccaccatggcgccgaggaactgctcctgctcacccttgaccgcgctggcgaggaaataaccgggaataccgctggtaacgcccacggcatagaagcgtccgctgccctggctgcgggtctggctgaagtaggggcgaaaaccgtagttgtgcccgacatagctgctgggcaggcgccagttgctggcggccacggcgaggccggtgtggtccagcagttccagggtcgaggagcgggcggcgccgttgatttgttccagtttgcggttcagggcgtcctgctgctgcgggccgaccgggcccttgagcgccgagcgcagttccgggtccagcgccagcacggcgggcagggcgcggtaacgttcgatcagggtatgcagggagttggcgtacaacgccagttgctcgctggcgcgggcggcatcgtcctccagcgcctggcgctcggcatggcgcatggcgaaggtcgcgctgaccacggcgccggcgagaatcaccagggtatagaaggtcaagcgcagcgggcgggagatctggaccatgagtcaagggcaggcagaaagggggcaggaaagataacacgcctgtccgaggcttcgttgatcgtggacagcccctgcccgggcaggcatgaaaaaggcggcgctgctcatcgagcaacgccgccttgggtaacagcaagcagcgcttactgcacttctaccgccaggctttcactgatctttttctgccagatggcaggaccggtgatgtgcaccgactcgcctttgctgtcgaccgcgacagtgaccggcatgtctttgacttcgaactcgtagatcgcttccatgcccagttcggcaaaggccaggaccttggacttcttgatcgcctgggccaccaggtaggcagcgccgccgacggccatcaggtacacggccttgctgtccttgatcgcttcgatcgcggtcgggccgcgctcggacttgccgatcatgcccaagaggccagtctgctcgaggatctggcgggtgaacttgtccatccgcgtcgcggtggtcgggccagccgggcccaccacttcgtcaccgaccggatcgaccgggccgacgtagtagatgaagcgccccttgaggtccaccggcagggtttcgcccttgttcagcatctcgaccatgcgcttgtgcgcggcgtcgcgaccggtgagcatcttgccgttgagcaggacggtttcgcccggcttccagctctgcacttcttccggggtcagggtgtcgaggttgacgcgacgggccgacggaccggcttcccagacgatttccgggtaggcgtccaggggtggcgcttccagggacgcagggccggagccgtcgagcacgaagtgcgcgtgacgggtcgcggcgcagttcgggatcatgcacaccggcagggaggcggcgtgggtcgggtagtccatgatcttcacgtcgagcacggtggtcaggccgcccaggccctgggcaccgatgcccagctggttgaccttctcgaacagctccaggcgcatctcttcgatacggttctgtgggccgcgggccttcagctcgtggatgtcgatggactccatcaacacttccttggccatcaccgcggctttctcggcggtgccgccgatgccgatgccgagcatgcccggtgggcaccagccggcgcccatggtcggaacggtcttcagcacccagtcgacgatcgagtcggacgggttgagcatggccatcttcgacttgttctcggagccgccgcccttggccgccacgtccacttccacggtgttgccgggaacgatggagtagtggatgaccgccggggtgttgtccttggtgtttttacgagcgcccgccgggtcggcgaggatcgaggcccgcaggacgttttccggcaggttgtaagcgcgacgcacgccttcgttgatcatgtcgtccaggctcatggtcgcgccgtcccagcgcacgtccatgcccacgcgtacgaatacggtgacgataccggtgtcctggcagatcgggcggtggccggtggcacacatgcgcgagttgatcaggatctgcgccatggagtcacgggccgcaggcgattcttcgcgcaggtaggcttcgtgcatcgcctggatgaagtccacggggtggtagtaggaaatgaattgcagggcgtcggcaacgctctgaatcaggtcgtcttgcttgatcacggtcatgagtcgcgctcctctaaaagacgggaacatttaataaggtgcttgcagcttgggtgcatcggtcggttgcaagcaccttcaaggcacgccggacacactggcgcgacgctaaaaaggcgcggcagtataccgcgcctcggggccgggcacacgcgccggcagtcaaaccaaagtcgcatgccgggcatgcgccggtcgggggatggcgccaggcatgacggtgggcgcggtcccgggctggatggcactgggcgggaacaaaaatgggatagttattttttggcgacaccactaaagtggcaagtggcctgtagggtaggaaactctttaaagccccctttcgcatggtgagtcaacgattgacccataacgctatccagagtcttttactcaagcgcttcgttcttgcggcgggtacctatggactggcgttgctgctgctctggctggccattttcagtggctactattcggcgtcggtgcattcggcgctgatcgataccggcctggtggtgctgagccaggcgctgctgttctggctgtttgtctccgggcgcaacctgcgctttcgcgacccgagcctgaccgagatccagatactcctggctatcggctggcagacctggctgctggcccacctcgatacggcgcgcggcaccttcctggtgttctacctgctgacactgttgttcggcctgttccaccttccgcgccgggccttcgtgcggtgcgccctgtgcattttcatcggctttgccggaatcacgctgtgggactgctaccacttccggctggccgatccgatgcttgccgtcctgcaggtgtgcgtgctgttcgcggtgctgatctggctgtgcctgtacgccagctatgtgcagacttcccggcagcgcatgcggcaacggcgcttcgccttgcaggcgcaccaggacaccttgcgcggcatgatgcgacaactggaggacctggtcgccactgacgaactgaccggcctgtacaatcgacggcatttcctgcggctggcgtcgcgcgaactgcacgcgatgagcctggagcagatgcatggcctggcgctgatcgacctcgatcacttcaagcggatcaacgacgtgcacggccatgccgcgggcgatcaggtgctgcaggcgttcgccgccgtagccagcgcctgcttgcgcgatggcgatgtattggcccgctacggcggcgaggagtttgtcatgttgttgcccgattgcgatcccgaacgcctgacctcctgctgcgagcgtctgcgcgtggcctttatggacgcccagttgatcggggtcgaggtgcccggcctgagcctgtccgtggggatgaccctggtggagctgggcgacgatctggacgatgccctgcaacgtgccgaccaggcgctgtatcgggccaagcgcgacggacgcaatcgctgcgccgcggcctgggaaaatatcgatgcctgagctgcgtgtcggtgagcggcagtggtcggtggtcgctggcagcaatctgctggatgccttgaatcaggccggcgtggcggtgccttacagctgccgcgccggcagttgccacgcctgcctggtgcactgcgtcgagggcctgcccagcgacagccggcccgatgccttgagcgacgatcagcgccagcgcggttggcggctggcctgtcagtgtcaggtggtggaagacctgcaggtcgaaacctacgacccgctgcgcgatggcgcgccggccgaggtggtcggtgtggactggctgtcggccacggtgctgcgcctgcgtttgcagccggagcgcaacctgcgttatcagaccggccagcacctggtgctgtggacggcttccggcgtggcgcggccgtattcgctggcgagcctgcccggcgaagaccgctttctcgagttccacctcgattgccgccagcccggcgcgttcagcgacgcggcgcgccagctcaagcccggcgatgggttgcgcctgggcgagctgcgcggcggggcgctgcactacgacccggactggcaaacccggccattgtggctgctggcggcgggcaccgggctagggccgttgttcggtatcctgcgcgaggctttgcgccaggatcatcagggcgacatccgcgtcattcacctggcccatgacgccagcgaacattacctggccaagcccctggcggcgctggcggcgagccacgccaacctcagtgtcgagctgttgaccgcgaccgagctgccagcggctttggcacaactgcggcttgtttcgcggcaaacccaggccttactctgcgggcaccccgacagcgtcgatgccttcgcccgacgcttgtacctggcggggctgtcgcgcaatcaactgctggccgacgtattcctgccccgtggttgagcgctgatccggcctgagcgagaccacccatgaccgataccatcctgcttgaacgcgagggcgggctgctgaccctgcgcctgaatcgcccggacaagaaaaatgccctgacccgggccatgtacagccagttggccgaaggactgcggcaagccgacgccgaccctgaggtccgcgcggtactgatcagcggcagcagcgattgctttaccgccggcaacgacattgccgacttcctccagcagccacctaccggtctcgacagcccggtcttccagttcatgctcagcctgttcgagtgccgcaagccggtggtcgccgcggttgccgggccggccgtggggattggcaccaccctgctgctgcattgcgacctggtgtacgtcagccgcgatgcccggttgcgcatgcctttcgtcaatctcggtttgtgcccagagttcggttccagcctgatcctgccgcgcttgctcgggcaggccagggccgccgagctgttgctgctgggcgaaggtttcagcggtgaacaggctgcgcagtggggcattgccaacctggccttggccgacggtgcggcgaccctggacaaggcccgggagatggcgctgcgtttcgagaagctggcgccgcaggcggtgcagatcagcaagcagctgatgcgcacgcccgatcgcgaacagctgcgcaaggtgatcgaggaggagggcgccctgttcacccagcgcctgcattcgccagaagcgctggccgccttgtcgggctttttcgccaagtcttgagcgcactccctgtaggagcgagcttgctcgcgatccaggcgccgcggtttagctgccaaaccgcgttatcgttcatcgcgagcaagctcgctcctacaggaaggcgaggagggcgggcataaaaaagccccgccgtgaaaacggcggggctttttattgtgacgccaggggactcagaccatcgggtcgccaacgtgcaggatcttcatgccgttggtgccgccggtggtgtggtagctgtcgcccttggtcaggatcacccagtcgcctttcttcacgacgccgcgcttgaccagctcgtcgatggccttctggctgacttcgcttggcggcagggacgccgggtcgaacgggatggtgtagacgccacggaacatcgcggtgcgggcctgggcttcgcggtgcggggtgaacgcgtagatcggcaccgaggaacggatacgcgacatgatcagcggggtgtagccgctttcagtcaaggcgatgatcgccttcacgcccgggaagtggttggcggtgtacatggtggccagggcaatgctctcgtcgcagcgctcgaaggtcttgccgatgcggtggctggaggtcttgctggtcggatgcttttccgcgccgatgcagatgcggtccatggcctggacggcttcgagcgggtaggcgccggcggcggattcggccgagagcatcacggcgtcggtgtagtcgagcacggcgttggccacgtcggacacttcggcgcgggtcggcatcgggttctggatcatcgactccatcatctgggtcgcgacgatcaccgccttgttgtggcgacgggcgtgcagaatgattttcttctggatgcccaccagctcggcgtcgccgatttccacgcccaggtcgccacgggccaccatcacggcgtcggaggccttgatcaggccgtcgagggtttcgtcgttggccacggcttcggcgcgctcgatcttcgccaccagccaggcggtgccgccggcctcgtcgcgcagttggcgggcgtattccatgtcagcggcgtcgcgcgggaaggacacggccaggtagtccaggtccatggccgcggccagcttgatgtcggccttgtctttttcggtcagggccggggcggtcaggccaccaccgcgacggttgatgcctttgtggtccgacagcgggccgccgatggtcacggtgcaatgcagttcggtgctggtggcggtgtcgacgcgcatcaccacgcggccgtcgtcgagcagcagctcgtcgcccacgccgcagtccttgaccaggtctggatagtcgatgccgacgatatcctgggtaccttcggtcagcgggtggctggtggagaaggtgaacttgtcaccgatcttcagctcgatgcgcttgttggcgaatttggcgatacggatcttcgggccttgcaggtcacccagcagcgcgacgaagcgcccatgcttggcggccaggtcacgcaccagcttggcgcgagccttgtgctcgtccggggtgccgtgggagaagttcaggcgggcgacgtccaggccagccagaatcagctgttcgagaacttccggcgagttactggccgggccaagggtagcgacgattttggtacgacggacggacatgcaaagactcctgagttcaagcgcaacgagaggctactatggtccgcagctgtagtcattgttcgtttgcactacttattcgtttgtttctttaaacgaacattcctgaagattttccaacgcgggtcgataacgtgcacaagacaggagaacccccatgcgattcgtgctcattgctgccctggccgtcagtgttgtcggctgtacccgctggtcgatggaccatcatctgaataccgcctaccgcgcctacgacgccggcaactgcgaacgggtgatgctcgaactgagccaggtcgaccgcacgagtcgttcgcgcccttatatccagcccgaagtatcgatgctgcgcggacagtgcctggagcggcagaagctgttcctcgatgccgcgcagacctaccagtacatcatcaccgaacaccccagcagcgagtacgcctaccgcgcccgcgcgcgcctggaaaccctgcagcaactgggtcattacccttcgcgcaacagcgctcaggcgcgtccgaccgcgttgtaacaatcgtcatcaggctattgctgatctcgcgtgagccttgagctaacatctgtgggcctgttttagagtattgtttctaaaatgggccggccggggtcgacagtcctcggcgcgacaatgcgcaatgaccttcttaaatagcgatgcatgacatgttcacggaccggcggatcgagcggcaccagttgccgtgttttttgaaagtcttcaatcggctgaccgatcgacccatcggttatctgggcaacgtttccgaagatggcttcatgttgatcagccagttgccgatgctgatcggcgccgatttcgagttgcgcctgcaggtgcccggccgcgacggccagctgcaaccgatcgagatcactgcctcttgtcgttggtgccatgaagatgtcacgccccatcattacgacaccggcttcgtgctgctgcgttcgcctcccgagtaccgcgagctggtgatggccttgcgcagctacttcagtttctacccggtgcagacctccgcctgaccgctacagggtcccggcctttttccagctgaggtaacgggtcaccagttccgcccccagttcacccggccgcacatcgagcagggcaacgccctgggcgctcaggcgttcatgcaggtcggtgcgggcattcaggtaattgatcgtgccgcagtaggtcagggcgtcggacaggttgtgcaccggcgcctggcgcaactgatcgaggacttcctcgcgcaggctggccaccagcacccggtgctggcgcccgaggcgcttgaccgcggtcagcagctcctcgtcgtcttcgtcccgcaggttggtcaccagcaccaccagggcccggcgtttctgccgggccagcagctcgctggcggcggcctggaagtcggcgcagcgctggctgctgtccaggtcgtagacagtgttgagcaaggcgctcaactggcctgcgcccttgaccggcgccagatagcggcggcgttcgccggcaaaggtgctcaggcctaccgcgtcgccctggcgcaaggcgacataactgagcagcaggcaggcgttgagcgcgtggtcgaaatgcgccagttcgccgtcctggctgcgcatgcgccgcccgcagtcgagcatgaagacgatctgttggtcgcgttcgtcttggtactcgcgggcaatcggcgtgcgttgccgggcggtggctttccagtcgatctggcgcaggctgtcgccctcgcgaaactcgcgcagctggttgaactccaggcccaggccacggcgcggctgttgccgcacgccgatctggttcagccagttgtcgacggccagcagccgggcgccgtagaggcgggcgaaatccgggtagacgcgcgtgctgtcgtcgagcttcagcaaccgacgcgccgaccacaggcccagcgggctgggcaggttgacctcgcagcgctcgaagttgaaatggccgcgcttgagcgggcgcacccgataacccagttcctgcgactggcccggctccaggagcagcgactgcggcaggtattcgaagcccaggccatcgggcacatgatcgaacagctccagggtcagcggttgggtaaagtcgtggcgaacctccaggcgcacttcgctccagcgccccaggggcaggctgccgggcaactggcgccgcagttggggggaaggcaggcgcctgagccggaaggcgtccagcacggccagcagcaacagggccaggagcaggccccaggcaatcgcttgcaggctggccgcgaccgccaggccgtaggcacgcgcggcgccgagcagcacgtccagcgccagcaatacgccgagccaggtcagaaacaggcgtgagggcttcatcgctttggcgggctcatagtcatgaagctcacagtcgcggcgccggtacttgatcgagcagttgcttgagcacctgctccaccgacaagccttcgatatccagctccggggcgatccgcacgcgatgccgcagcaccgccagggcgcagcccttgatgtcatccggaatgacgaactcgccgccccgcagcaaggccctggcccgtgctccgcggaccagggcgatcgatgcccgcggcccggcgccgagggtcagccccggccagctgcgagtggcccgggccagccgcacggcgtagtcgaggacctgctcgtccagcggcaggtcgctggcgatccgttgcagggccagcacgtccttggcctgcagcagggtacgcagcggctgcacgtcgagcatgtcggcccggggcgagcgggtgacctggcggaccatgttcaattcctggtcgctgtccgggtaatccatgcgcagcttgagcatgaaacggtcgagttcggcttccggcagcgggtaggtgccttcctgttcgatcgggttctgcgtggccaggaccatgaagggctgggcgatgggcagcgcccggccttcgagggtgacctggcgctcctgcatggcttcgagcagggcggcctgggtcttggccggcgcgcggttgatctcgtcggccagcagcaagtgggtgaacaaggggcccttgcgcagcttgaactgctcggtctgcaggtcgtagaccgcatggccggtgacgtcgctgggcatcaggtccggggtgaactggatgcgcgcgaactcgccgccaaagcaacgggccagggcgcgcaccagcaaggtcttgcccagcccgggcacgccttcgagcagcacgtggccaccggcgatcagggcggtgagcacgtcgtcgatcaccgcgtcctggccgatcacgaccttttgcagttcgtggcgcagggcctgggccagctggctggcgcgctggcgttgctggacggcatgcgcctgggcatggccgggctcggtggcgggaagcggttcggcgggaaggtcgctcatagggcattcctgagagtttgcaggtgggtgaccaggcggctgaagtcggcgctggaaaggcgttgtgccggctggggagccagggcctggctgatgacgctgtccggttgccgggtaaggcgggccaggacctgcccttgttcggtggcggtgagtcgttcgaaaccgggatgacgatgctgggcgcggcgcaggatgtcctgctgcaggctatgcagcagcccctgctgaccggtgtggcgcaacaggaagtgggcgctggcttgcaggtgctcgcgcaactggcgccgggccctgggcatcggggcctgcatcggtccgtggcgaaccccgacatgccacagccacaggccgagcagtgcggcgagggccaccagcgcctgggggaaatacttcagcagcaggctccagaggctgtcgtgatcagtgtcgaacagcagggtgacgtcgctgtcggcgctcaggtaccagagcagccaggcgttgtcgtacttggcgatcaacggagtcttccagatctcggcatcggtgagcacggtcaccgaacccaggccgtagctcagttgcatcatgtgggtggcccgggcgctgttggcccaggactgggcgaggttgtccgggtcttccaggtggaagtcggtgtcgaaaccgatgtaggccggcgcgtcttggtcttccaggtagagcttggtcagtttcgggtagggctctttgccggcgccgggtggagggggcttcaggtccttgctgagaaactggcgcaggtgcaggcgatcgagcagcaggtcgccgctgcgtccggcctctttattccacagcgcttcggcgacgaacagcaggcgcccgccggccctggcccagtccagcagttgctcgacctgctgcggcgtcatgttcgagcgctcgcccagcagcaacaggctgttctgctgcggcttgagggtcggcagcacctccaggccgttggcgtgctgaacctgcaagccgcgctggcgcaggaacatttccgccgccaggtatgggttggcgcgggcttgcggagaggggccgtgatcgatggtttcctggtagggccgggcgttgaggtagaggtacagtagcaagccgccgagcaggccggcgaccagcagcgcgagcagcggcagcaggcgccggttcatcgtggggctcccgggccgaacagggtacgccagccatcgcacagctcctgcttcagctgtgcgggaggcaggcgatgaccgtaggccaggttctgccagtgccgggtcaggctgttgctgaacgcctgcaactggggcaactgcaaagccttgatctgctcgaggacctggccctcggtgtccgccggtttcaacggcaggcggaagtcatgcaggagccggctcagtagcgcgcggtacaacagcccaagggcttcgcgtggctgctgtggccagagtgcctcggcagcggcggcgacatcctcgggcaaggcgtcggggctgaggtccaggccgaacagctggtgcggagcggctcgcgcgggtagtttgcccggcagcggacggcggccgacaaaggcccgcaaccattcacgatgacgccataccagcagggccagcgcccccagcagcagggcccagagcaggatctccagggccttggccgcggcgctgaagacgctgctgtcgagccgatcgatcagggccttgagccagcccggcagttcagagtgttcagcgcttttcgggttgtcttcgtcgaaccggtaacgggtcacggtctgcgggttcttgaagggcggctggtcgaggatctggctgatgctgtctttcgcggcctggctggtcagcggctgatccagcaggcgcgggctgtcagggccagtggccggctcggcggcccaggcctctggcgccaggggcagcacgctcaggctgcccaggaccaacagcagggcggcgccactcaagcgctgccgcaggcggcgcagcaccagttcgatatcccaggcctccagcagcgtgcggcgattgaggtagaggctgaagccgcaggcgacgtacaccggctcccagacaatcaagaccagagcatagaaagcgttggtcaggtgttcgagccagagccagtcctgctcggcggcggcaattaacgtctgccagtcccagtccagctcgatttgttgtggcagcagcagatagaacaacgccagcaggccgatccacaagatgccttccaggtgcatgccgatcagggtcagccagtgcgcggccccggcattgcgctgttgcagcacccgcacccgttgctggcgcgcctcgccgctcaggccctcgagctgcaccacgggcatgatgaagctgcggctcaggctcaggcggcgccaggtcaggcttgccagcagttgcggcttgagcagcctgggccattggcgcagggcctggcgcaaggtcggggtttcgccgaacagggctttggcgaggatgtacagcggcagccgttcgaaggccggcttgagccaccagaacagcagcagggcgagggtgggcgagtcccagagcaacaggctgagcagggcgaacaccggcagggtgatcagcgcccagctggtcattagcaggcgtcggtggcgctggctcagcagtactcccaggtccatggcttcccaggtcgtgcgcgggcgaatcaccacgctggcttcactcaggcgcatggcggcgtccagcgaatatcaggtaggccaggaccagcagccagcagatgccgccgaccaggtatttgatccaggccgcgggccaggtcagggaggaccaataggcttcgataaaggcagcgatcagcaggaacaggatgaccccgcagatcaactgcacgctggtgcgcgcggccagcagcaaggcttcgccgcggggcaggcgtccgggggcgatcagcgcccagcccattttcaatcccgccgcgccggccagggcgatggcgctgagctcgaaggcactgtggccgacgacaaacgaccagaaggtggcgccatagccgatctgggtcaggtgcccggccaccgcgccgatggtcaggccgttgaagaacaggaagaacaggctccccaggccaaacagcaggccgctggcaaaggtctgaaaagcgatgccgatgttgttcatgatgtagtagccgaacatcatccagtcttcgccggcggcccggttggcgaggcggcccaggcgactggcgcctggatcgtagaggcgttgcatttcggccacctgttgcgggctgaccacgctgtagatcaactcgggcaccaggtacaccagcaggccgatacccagcaggctgccaaagaacaccaggctggcggccaggacgaagcgccattgttcgcgcaccagctgcgggaaaccggccaggacaaagcccaggacccgggcgcccaacgggctgcgttggcgatagagctgctgatgcccgcgcagcgccagttgttgcaacgggtcgaccaggaagctgctgtagccgcgttcctgggccagggccaggtgttggcacaagcggcggtaatcctcggggaaacgggcataggtctcgggcgtcgcctggccgcgttccagttgttcgagctgttcgcgcaggcgctgccacaaggcttgatgacggttttcgaacaggctctgtttcatgtcggccccagcagtccgcgggcgatgccattgagttcgtcacgggcctgcgcgggcgttacatgcagaggctcggcgagcagcgcggccagctcctggacccggtccgcggacagttgttcctggcgttcggcgaagctgaggatggcccgttgttcagtcaggctcagggcgaaggcggcggttctggcgggcactgccggcaaggtcgggcgaaccaccggctgctcgcggtagatcaccagggtgccggccgccaggtcgccgaggcgcttgaaggtcgggtgctgcaggcaactgatggcgccgaggcaataaccgaacggcagcatgtcgacaaaacgcagcaggttgcgggtcagggaagggccccagccgatgggcgtgccatcatcctgcacgacccgcaggcccatcagttgcttgcctggcgagcagccctggttcaacacctcgaacagcaccatgtaccaccagctgaccagaaacagcaggatcgagcccagccccatgccgagctggccgagaaaccccaggacaataaacagcacgccgaggatcaggccacgaaagcccaggtcgatggcaaaggccagggcgcgcgacatcagccccgccggccgtagcggcaggtcgatgccttctggcgtttcgacctggtagcgggtgtccagtggcgggggcaatgctttccctggcagtgctgtcgtctcgagcataggcaacttgaggctggcctggtggcgatggatgaccgcctgatgctagcagtgtcggaggggcgaacgacatcatttactgtgtcgcgtgacgtgcgccgttacccttgaatcatcacaaggctggccgcggccggtgccaagcgcctagactttgccggtcttttgctcaggaacagcccgtgacttccatcttctggtacgactacgaaaccaccggcatcaacccgcgctgcgatcggccgttgcaggtggcggggattcgcaccgacttcgaactcaacgagatcggcgagccggtcaatctttactgtcagcccagcgacgacatcctgccccatccagcggcctgcatgatcaccggcattaccccgggccggctggccgaacaggggctgagcgaagccgatttcatgacccgggtgcacgcccagctggcggcaccgggcacctgtggcgccggctacaacaccctgcgcttcgacgacgagatgacccgctacagcctgtaccggaatttcttcgacccttatgcccgcgagtggcaaggcggcaacagccgctgggacctgatcgatgtggtgcgcaccgcctatgccttgcgcccggaaggaattgtctggccgcgggacgaggaggggcgggtgaccctgaagctggagcgcctgaccgccgctaatggcatcgatcacgggcatgcccacgaagcactgtccgatgtgcgcgccactattgccctggccaggttgattcgggacaagcagccgaagttgtatgaatggctgttccagttgcgcagcaagcagaaagtcatggaccaggttcgtctgctgcaaccgctggtgcatatttccggacgcttttccgcggcgcgcagttatgtcggcgtggtcctgccgctggcctggcatccgcgcaaccgcaacgccctgattgtctgtgacctgcacctggacccacagggattgctcgagctggacgccgagacgctgcgccagcgtttgtatacccgccgcgaagacctggccgaaggcgagttgccggtgccgttgaagctgatccatatcaaccgctgtccggtcgtcgcgccgctgaatgtgttgcgtggcgaagaccagcagcgtttgcaactggacatggcggaatataaggcccgggcgctgcggctaagtgacgcacaagaagtttggcgggataaacttgcggctatttatgccagcgaggactttgcccccagcgtcgatcccgagcagcagttgtacgacggttttatcggcgatcgcgaccgacgcttatgcgaacaagtgcgcaatgccgagccgcttcatttagggcaagagcaatggccgttcgatgatgaacgtttgcccgaattattatttcgttatcgcgcccgtaactttcctgaaaccttgaacggggaggagcaagaacgctggaagtcattctgtcagcagcgcctgtgcgacccgcagtggggagcgcccaataccctggaaagtttcaatcaggtggctgccgaactacggctgagtgctacaacgattcagcgtcaggtgctggatgaatggcaggattacagccagtcgctggccctgcgtttcgggctttgattgttcggcttagtacattccgggcatttgccggaaataaaaaaacgccagcaagctggcgttttttcataaggtcgcaaatccctctgtgacggctatacggcttaacccagcagggttgcccagccttcgaccacgtcgccgccccacttggctttccactctttcagggttttgtggttgccgcccttggtttcgatgacttcgccgttgtgcgggttcttgtattgtttgaccttgcgtgcgcgcttggtgccggtagttttggcggcaacacgtggcgccttaactttcgagtccggatccagcagcgcgatgatgtcgcgcagggacttggagtattcacccatcagggcgcgcagtttgccttcgaattccagctcggcttgcagtttgtcgtcttgcgacaggttcttcaaacgggcttgcagctctttgatagcttcttctgtggcgcggtattcgttgatcagggacatgagaattgccttatgttgagtgctgagtggcaggtgacagtggcgtaataatagtcaggcagtttcctcaagtaaacaataaagccggcttttatttaatttgattagagtgtttagcaaagatcctgattgatgagttaaatattgtgaacgagtccgcacgactatttcccacaaagttataggactatttccaagtgtggctgattttcctctcgcatcgggcatgagccctacaggctgctcagaggaatcggattccgacatcacgaatactgcagttttgtcgcgcaatcgctagaatggcggcctttgcgaagttctggagtttccccctcatgcgcacttttcggttggtgatttcctgcccggaccgcgttggcatcgttgccaaagtcagtaactttctggcgtcccacaacggctggatcaccgaagccagtcaccactcggatgacctgagtggctggttcttcatgcgtcacgaaatacgtgccgactctttgccgttcggccttgaagcctttcgtgaagcctttgcgccgattgccgaagagttctcgatggactggcgcatcaccgataccgcgcagaagaagcgcgtggtgttgatggccagccgtgagtcccactgcctggcggacctgttgcaccgctggcacagcgacgaactcgactgcgagatctcctgtgtgatttccaaccacgacgacttgcgcagcatggtcgaatggcatggcattccttattaccacgtgccggtcaaccctcaggacaaggagccggcgttcgccgaggtctcgcgcctggtcaagcagcacgacgccgaagtggtggtactggcgcgctacatgcagatcctgccgccagagctgtgccgcgaatacgcgcacaaggtgatcaacattcaccacagcttcctgccgtcgttcgtcggcgccaagccttaccaccaggcttccctgcgtggtgtgaagctgatcggcgcgacctgccactacgtgaccgaagagctggatgccggcccgatcatcgagcaggacgtggtccgtgtcagccacagcgacagcatcgaagatatggtgcgtttcggccgtgacgtcgagaaaatggtcctggcccgcggcctgcgctaccacctggaagaccgcgtgctggtgcacggcaacaagactgtcgtgttctgatccagagtgttctgattaaaagcgctctgatcgaatccgccgggcccgggcatccaagccccaggtccggcgatttttcatgaggatcgaccgatgagtgatccactggacaaagccacatccaaggcgcccgccaccctcggcgagggctgcctgagccgttacgacccggacgacatgagtgccgagaacggtaccgagtttcccggtgccgccgagttgtggcagcagttgcagcaggatgccccggatacagagccgcctaagcctgcttgagcttcatcagggtgcgcagcaaggggcgcccgaccatcatcaggaataccggcccgccggccagcagatagaaatagtaggtaacggcccgccagatcaggatggccgcggccgccgtcgatttccccaccatgggcgccagcagcgccgccgatgtcagctccgccgctcccgcgccgccgggcagcaggctgaattgccctgcgctcagggcgagcatctggatcagaaaggtccaggcccattgcaggtccacccccagcccgcgcaacgccaagtacagcacactgtagcgcagcgcccaatgcatgcaggtcagggcaaagacccccgtcagggtctgccagggcagtttcaggctatcgccgaaggccttgaggaaatgcagccatttgcgcgcccggcgccgacgggtcgaggggcgaatcttgaagggcgcaagcagatggccgctgagcaggatcaggcgacggtggtagcgggctatcgccaggcagatgcataacccgccgaacagcgaaaggctgctgagggccagcagccactccaggcgctggctgaggttctggaacagcgcgtagaacaggatccccagcagcgcgcagaggaagaacagcaggtcgctcaattgatccatggcgaacaccgcgctgccgtaagccgggcgcacgccgttacgcgccagcagggccatcaaggtcagggggccgccactgccgccgggcgtggcgcacatggcgaactcggtggacatcaccaccgcgagactcttccagcgtcccagccggccgcgatgtcggcctagcagcaggctcaggcgcagcgaattgatgatccagcacagcagaatcatgctcagcatgcccagcagcaacggcagggaaaaacgctggacccgcccccacagttcgccgccgcccagcagcagcggcaccaggagcgccgccaacaaggccatggccagccagatcgcccggctcatggggtaccgcgtgcccttggcggctgggtgtcgagccagtcggccttggtcagtggctggcgtccttgctccagcaggcgttcgagggtgtccagccagtactggcgcgagtcggggtgacgcatgtctaccgggtgcaagccgaggcgaatcaccgatgcctgctgccagcgtcgttcgcgttgcaggctgagcagccgggaggctttgcggcgccaggcgctgcgggcgctccacaccagaccgggggcggcgatcggcgagaagtctggcagccggtacagctgctgcgggccactggtgtagcgcaggggcagttggcgcagggcctggcgcgtacccgggctcatcagccaggcgggggcgacgaagccctgcaagggccagttgtaacgctggaacagttccaggccggcatgcaggcgtgccagggcggcgttttccgagaggctgtagaactcaccctcatgggtgtacacgcgacgcatgaaccagtcatacggggtgcgcggtggcggaccctcgtcgcaatggaagtaaccgtgcagcaccagttcgtcgccgcgttccaggcgcgcgctgagcagacggcgaaagccgggatgagcatcgagcgggttgtgccggtgaaaatccggtaccaccagccaggtcatcggcacgttgcccatggcgtcgacggcttcgacgaagggttggtagtcgatccaggtttgtggcgcgacatcgtgcaataccagaagcacgctgggcaccccggcggactcaaccatgggccagcatcggctgctgggtgccgagcacggcgcgatagtgctccagcaggctggcgaccaccgtatcccaggcgtaataacgttcgacatggcggcgcgcccgttggccccgctcggcgcagccttgggcgaacagctcctgcacggcacgggccatcgccagcggattgttcggcgcacagagcaagccgccttccgcggtgacgatttcctggaaggccccggcggccaccgccaccacgggaatgccgctggccatggcttcgaggatcaccaggccaaaggtttcctggtccccggcgtggaccagggcatcggcgctggccatcaggcgggcgacctgaggggccgggcagaactcgtcgatcaccgtgacattctccggcacggcggtcggcatggccgagcccaccagcagcaggtggtagcgcttgcccaggcgttgcatgcagttgagcagcaccggcaggttcttttccttggagccgcgaccggcaaagatcagcaggcggctgtcttcggcaatccccagttcggtgcgcaggccggggtctcgatgactcgggtggaaggtctgcaggtcgacgcccagcggttgcacatagacgttgcgcacgcccaggccgatcagtttgtcggccatgacctggctgggggccaggacccggtcgaagttgccgtacagcttgcgcacgtaggcctcgacattcggggtgaaccaggggcccatgcggttgctgaccagcagcggcaggtccgagtgataaaaaccgatcacaggtacatccaactggcgccgcgcatccagggccgcccaggcggtgaggtaagggtcgccgacttcgatcaggtccggttgcaggccatggagaatattgcgccagggccccaggcgcaggggaaaacggtagcccttgccaaagggcagggcgggagcggggacttcatagatgccgtcgcgttcgctgaagtgggccccggggatcagcaaactgtggcggattcctggttggcgtcccaggcgacgatgcttggcgtccagataagtgcgcacgccaccgctggcaggggcgtagaacatggttatgtcagcgatatgcacgatgatcatccctccgatccggtgttctccctagggttgacccttatcaaggatagatgttcggtcgggatgccgtggcggttggcgatgcgtctggatgaacggcctgctgcggatgcgggagggattgtcggcagtccggtgcctgggtgttgcccaggcgccgggtggctgaagggatcagatacggaaactgccgaccagttgcttcaggcgtgcggcctgctgctcgaggtcggaacaggcgcgcagggtcgactgcaggttttccaccccttcctggttcagggtgttgatctcggtgatgtccatgttgatcgactccaccaccgaggtctgttcctcggtcgcggtagccacggactggttcatgccgtcgatctcgccgatgcgctgggtcacgctgttcaggcgctcgccggcctggttggcgatctccacgctgtcctggctgtggcgctggctgttgctcatggtgctgaccgactcgcgggcgccgacctgcaactcctcgatcatggtctgcacctgttgcgccgattcctgggtgcggtgggccaggttgcgcacctcgtcggcaaccacggcgaagccgcgcccggcctcgcccgcccgcgccgcctcgatggccgcgttgagggccagcaggttggtctgctgggagatgctggtgatgacttcgaggatctgcccgatgttcacggtcttgctgttgagggtttcgatgttgctgctggaggcgctgatcatgtccgacagctggttcatcgccaggatgctgcggtccaccacttgctggccgtcctcggccaggctgcgcgcgtcgctggcctgctgcgaagcctgggcggcgttgcgggcgatttcctgggcggcggcgccgagctgattgatcgccgcggccacgctgttggtgcggctggcctgctcgtcggagttgagcatcgacgaattggaggcgctgaccacgcgcagggcgacttcgttgacgtgctcggtggccgacgacacttcgcggatcgaaccgtggatgcgttccacgaagcggttgaacgcggtgccgaggatgccgaattcatcctggttctggatggtcaggcggcgggtcaggtcgccttcgccgtcggcgatgtcctgcatggcgcgggtcatgacatgcaggggctgcatcagcacccggatcagcatgcccagcagggcgatgatgatggccacggcgatgacggtggcaatgatggccgaagcgcggaactcgctgagcatcgagaacgccttgtccttgtccacggacaggccgatgtaccagttcaccgacggcagacccttgatcggggtgaaggtgacgatgcgggtcttgccctcgacttcgatttcgctgaaatcgccactgatgcgtggcgtgttctgcgggtaggcctcgctcaggctcttcatcaccagcgccttgtccggatgcaccaggatcttgccgtcggcgctgaccaggaaggcatagcccatgccgtcgaaatccagggcgttgagggtttcgatcagggtttgcaggctcaagtcgccgcccaccacgccgatgctttgcccgccgttacgcgaggcggtggcgacggaaatgatcaactggccggtagctgcatctatatagggttctgtgagggtcgagccgctgctgctttcggcacccttgtaccaggggcgaacgcgcggatcgaagccgtcgggcatcttcgcgtccgggcggatggtgaagctgccgctggcatcgcccaggtaggaggccatgaaggtcgaggtcagggccttctgttcgagcaggctggccaccttggtcgattgcggttcgatcgccaggttttgcgccaggttttcgatcagcaggatgcgcccggtgagccaggtctggatgttgctggcggtcacatcgcccatttcatgcaggtaattgtccaggtcttcgcggatcgcattgcgctgtaaatagtcgttgtacagcgtgaaggaagcgaaggcggcaataacgatgagggcggcggcaagcaggattttatggctgaagcgcaggtttttgttcatggcttgtggtgtccgctaggtcttaatgtcacgagcgtgctcttataaaagcgcgcaaaatgggcggggttgaaagtaagttgatatttccacctctccttggggaattatctgaactatttttcagtcttttctaatctatcggccggtcaaggctaaagattaaccatgggtgacaaaatgccggattcatcgcaactcgttatcggtgccgatctcgcggggcaaccgattgcccaggccatgcgcctggcaaatcgtcacgggctggtggcaggcgctaccgggacagggaaaaccgtcaccttgcagcgactggcggaagcgttcagcgatgccggtgtcgcggtgttcgccgcggacatcaagggtgacctgtgtggcttgggcgccgcgggcaatccccagggcaaggtcgccgaacgtattgccgggatgccgtggctgaaccacaagccccaggcttatccggtcacgttgtgggacattcacgggcagtccgggcacccgctgcgcactaccctgagtgaaatgggcccgctgctgctgggcagcctgctggagctgaccgacagccagcaatcggcgttgtacgcggcattcaaggtggccgaccgcgaagggctgttgctgctcgacctgaaagacctcaaggcgttgctcaaccacctcaaggacaacccgcagttgctgggggatgacgcggcgctgatgaccaccggctccagccaggccttgttgcggcgcctggcgactctggaacagcagggcgccgaggccctgttcggcgagccggccctgcaactggaagacatcctgcagccggccagtgacgggcgcgggcggatccacctgctcgacgctagccgcctggtgcacgaggcgcccaaggtctatgcgaccttcctgttgtggctgctggccgagctgttcgagcaactgccggagcgcggcgatgcggaaaagcctctgctggcgctgtttttcgacgaggcccacctgctgttcgccggcacgcccaaggcgttgcaggaccggctggaacaggtggtgcggctgattcgctccaagggcgtgggcgtgtacttcgtcacccagtccccaggcgacttgccggacgacgtgctggcgcaactggggctgcgcgtccagcacggcttgcgggccttcaccgccaaggaacagaagtccttgcgcgccgtggcggacggcttccggccgaacccggcgttcgatgcgctgtcggtgttgaccgagctggggattggcgaggcgctggtcggtaccctgcaggaaaaaggcacgccggagatggtccagcgagtgctggtggcgccgccgcaatcgcgcatcgggccgctgaccgaggccgaacgtaccgcgctgatcaacagttcgccgttggtcggccgctatgacaaaccggtcgaccgcgagtcggcctatgaagtgctgatgggacgcaagggcctggcaccggaggccgaggctgcgccgggcaaaccggccgcggaggaaccgagctttaccgatcgggccggcgagttcctcggtactgccgccggtcaggccctgaagtccgccatgcgtcaggccgccaatcagttgggccggcaactggtgcgcgggttgatggggtctctgctggggggcagcaagcgccgctgatcggcggctggtcggtcacgcccgtggtttggcgtggctggccaggcgctccagggcggcgcgcaggttgggatcggtgatgccgtcggcggtggcttgaatggtctcggcggcgttgctcgacaggtccatggtgtggccggccgcaccccgttgtacggtgggaggctgcactttgaacagaatccgcgtcagattgttgaactcattgaactccaaaagctgacgttgcaggcgtttttgctgataacgcaggcgcgttgcccagtggccgtcggtgacgatcagcaacaggctgccttcgcgccaggaggcaacgtggcagtgctcgcgcgcggccggttgcagctggctttccagcagacgctgcagatgcgccaggcgctgggcgtggccgagtatggctttgagaggcttggcttcgcgaaggagtacggcgggtgctctggccgtaagagggcgaaatgccatgatcagacacctgaagttacagagccgccatggtagcagaaagcgctggccggacctcgttcatcgctgcggcgaggctttatccattaaatcaatggttaacttcgtactcgtccgggttgaaactggcgcaaaaggccttattgtaagtgagccccgtcacagcgctgtaccagcatcgtggaataacgccactttcctcaccatcgtttccgggtagaatactcgttcgcatgcggccatgagggctgcacgggcgactcacggggccgccctccatccctatgtgtggaagatcctgccgatatgtttgcgcctttgttaaagaaactttttggaagcaagaacgagcgtgaagtcaaacgcatgctcaagacggtacagatcgtcaatgccttcgaagagcaaatggtggccctttcggacgatcagttgcgcgccaagaccgaagagttcaaggcccgcatagccaaaggtgaaaccctcgacaaactgcttcccgaagcctttgcggtcgcccgcgaagccggcaagcgggtcatgggtatgcgccactttgacgtacagttgatcggcggcatgaccttgcatgaaggcaagatcgccgaaatgcgtaccggtgaaggcaagaccctggtggcaacactgggcgtttacctcaacgcgctgtccggcaagggcgtgcacgtggtcacggtgaacgactatctggcccgccgcgacgccaactggatgcgcccgctgtatgaattcctcggcctgacggtcggcgtggtcacgccgttccagccgccggaagagaagcgcgccgcctacgccgccgacatcacctacggcaccaacaacgaattcggtttcgactacctgcgcgacaacatggctttcagcatggaagacaagttccagcgcgagctcaattttgccgtgatcgacgaagtcgactcgatcctgatcgacgaggcccgtaccccgctgatcatctccggccaggccgaagacagctccaagctctacaccgagatcaacaagctgatcccgcgccttgagcagcacatcgaggaagtggaaggcgaggtcaccaaggccggtcacttcaccgtcgacgagaagacccgtcaggtcgaactcaacgaagccggtcaccagttcatcgaagagatgctgacccaggtcggcctgctggcggaaggcgagagcctgtactcggcgcacaacctgggcctgctgacccacgtctatgccggtctgcgcgcgcacaaactgttcaaccgcaacgtcgaatacatcgtccaggatggccaggtggtcctggtggacgaacacaccggtcgtaccatgccgggtcgccgtctgtccgagggcctgcaccaggccatcgaagccaaggaaaacctcaacatccaggccgaaagccagaccctggcgtcgaccaccttccagaactacttccgtctgtacaccaagctgtccggcatgaccggtaccgcggacaccgaagcgttcgagttccatcagatctacggcctgcaggtgatggtgattccaccgaacaagccgctggctcgtaaagactacaacgacctggtgttcctgaccgcggacgagaaatatgccgcgatcatcaacgacatcaaggaatgcatgacccagggccgtccggttctggtgggtaccgcgaccatcgaaacttccgagcacatgtccaacctgctccagaaggaaggcatcgagcacaaggtcctgaacgccaagttccacgaaaaagaagcggaaatcattgcccaggccggtcgtccgggcgccctgaccatcgccaccaacatggccggtcgtggtaccgacatcctgttgggcggtaactgggaagtcgaagtcgcctccctggaaaacccgacccctgagcagattgcccagatcaaggctgactggcagaagcgccaccagcaagtgctggagtccggcggcctgcaggtgatcgcctccgagcgtcatgaatcgcgccgcattgacaaccagctgcgtggtcgcgccggtcgtcagggcgacgccggttccagccgtttctacctgtccctggaagacagcctgatgcgcatcttcgcctccgatcgggtgaagaacttcatgaaggctctgggcatgcagtccggcgaagccatcgagcaccgcatggtgaccaacgcgatcgaaaaggcccagcgcaaggtagaaggccgcaacttcgacattcgcaagcaactgctcgagttcgacgacgtcaacaacgaacagcgtaaagtgatctatcacatgcgtaacacgttgctggccgcggacaacatcggcgagaccatctccgacttccgccaggacgtgctcaacgccaccgtcagcgcgcacatccctccacaatcgctgcctgagcagtgggacgtggccggtctggaagcagcgttgcaaagcgacttcggtgtgtccctgccgatccagcaatggctcgacgaagatgatcacctgtacgaagaaaccctgcgcgagaagctgctcaacgagctggtggcggcgtacaacgagaaagaagaccaggccggtgccgaagcactgcgcaccttcgagaaacaaatcgttctgcgcgtactggacgacctgtggaaagaccacctgtcgaccatggaccacctgcgtcacggtattcatctgcgtggttatgcgcagaagaacccgaaacaggaatacaagcgcgagtccttcgccctgttctccgagttgctggattccatcaagcgcgactcgattcgtgtgctgtcgcacgttcaggttcgccgcgaggatccggtcgaggaagaggcgcgcctgcgtcaggaagccgaggcactggctcagcgcatgcagttcgagcatgccgaagcccctggcctggaacagccggaagcgctggaagagggcgtcgatgtcgacgtggccctggcttcggctccggtacgcaacgagcagaaactgggccgcaacgaactgtgctactgcggttcgggcaagaagtacaaacactgtcacggccagatcaactaagattttcgccagacactgaaatacccgcgccgcgaccggcatcagccgtcgcggcgtttttccattcgccgcactgccttttgcgatggcggtgcacacatcaggttaaagaggagcgcattcatggctgttggtcttggtcctttgccaacgttgcacccggttgccggttttgaacttggtatcgcttcggcgggcatcaagcgcccgggccgcaaggatgttgtggtcatgcgctgtgccgagggctctacggtggccggtgtgttcaccttgaacgcgttctgcgccgctccggtgatcctggccaagcagcgcgtgcagggccctgtgcgttacctgctgaccaacaccggtaacgccaacgccggcaccggtgagccaggcctggccgccgcgacccgcacttgcgccaagctggccgagctggctggcgtcgatgccagcgccgtactgccgtactccaccggggtcatcggcgagccgctgccggtcgagaagatcgaaggcgcgctgcaagccgcactggatgacctgtccgtggacaactgggccgccgccgccacgggcatcatgaccaccgacaccctgcccaagggtgccagccgccagttccagcacgacggcgtgaccatcaccgtcaccggtatcagcaagggcgcaggcatgattcgtccgaacatggcgaccatgctcggctacattgccaccgacgccaaagtctcccgtgaagtgctgcagaacctgctactggacggcgccaacaagtcgttcaaccgcatcaccatcgatggcgatacctccaccaacgactgctgcatgctgatcgccaccggccaggcagccctgccggaaatcaccgaagccagcggcccgctgttcgccgcgctgaaacaggcagtgttcgacgtgtgcatggaagtggcccaggccatcgtgcgtgacggtgaaggcgcgaccaagttcgtgacggtcgaagtcaacggcggcggcaatcaccaggagtgcctggatgtcggctacaccgtggcccactcgccgctgatcaagactgcgctgttcgcttccgacccgaactgggggcgtatcctggccgctgtcggccgtgccggcgtgccggacctggatgtgagcaagatcgacgttttcctcggtgaggtgtgtatcgccagccgtggcgcgcgtgccgccagctacaccgaagcccagggcgcggcggtgatgcagcaggaagaaatcaccatccgcatcgagctgggacgcggtgattgcagcgaaaccatctggaccaccgacctgtcccacgagtacgtgaaaatcaacgcggaataccgtacctgatacaccgctactcgcttctacatggacgcgacacatcacgtgtaggagcgagtctgctcgcgatggaggccccgggcctccatctcctctgaaaggtgcccgacatgaatcttcacctgatcatcggcgacaaactctattcctcctggtcgctgcgcgccgccctggcgcttgagttggccggcgcgacttacaccgaagaactgatcaagctgaaccagcccgatacccgcgagctgattctcaagcattcgccgaccggcaaagtcccgttgctgaagagcgagcacggcaccattgccgactcgctggcgattgccgaatacctggtcgagcgttttcccgaagccgagctctggccgcgggatgtggccgcccgtgcccaggcccgctcagcctgcgcgcagatgcacagtggctttttcggcttgcgcggcaatctgccgttcgacctgagtcgcgatgctgcgctttcacccatgccgcccgaggcccaggccgatatcgagcggatgctggcgttatgggccgaatgtcgcgcggccgcgacggagccagggcctttcctgtttggccgggtcagcctggcggacgccttttttgcgccaatcgccgtgcgcctgcgtacctatcgggtggcgctgccggctgtcgatgccgcctatgttgaaacgatctatcaatggccagccttcaaggcctggcagaaagccggtttagaggaagcagtgcggtgaaacgagtacatgtggcggcggccgttatccgtgatgccgatggcaggatcctgattgcccgacgtgccgatacccagcatcagggcggcctctgggagtttcccggcggcaaggtcgaagcgtacgaggcggtggaagcggcgttgacccgtgagctgcaggaggaactgggcattctggtgtcccaggcgcggcctttaatcaaagtgcagcacgattacccggacaagcaggtgttgctggatgtctgggaagtgtgcgcctttaccggcgagccccatggcgccgagggccagcctttggcctgggtcacggcccgtgagctggagaactacgagttcccggcggccaaccagccgatcgtggcggcggcgcgcttgccgagtgactacctgatcaccccggaaggcctggaaacaccggcgctgttgcggggcatgcagaaggccattgccggcggcagcaagttgatccagctacgcgcgcccaacggctacgacccgcaataccgcgacctggcggtggatgcggtcggcctgtgcgcgggcaaggcgcaattgatgctcaaggggccgttcgaatggctgggggatttcccctcggcgggctggcatatcacttcggcgcagctgcgcaaatacgccagcgccggacgtccctttggcaaggagcgctggctggcggcgtcttgccatgacgctgaagagttgtccttggcgcagcagatggatgtggacttcgtgacgctgtcgccggtccagccgacccagacccaccctgaggcgcagccactgggttgggagcaggccgcccgactgatcagcggtttcaacaagccggtgtacctgctgggcggtgtcggtccggatcagcgcgagcaggcctggcaggccggtgcgcaaggggtggcggggattcgcgcgttctggccctgaggccattcacccgccagttcgctcctgcataagctgcaggagcgggcttgctcgcgaccggcggagaaaaacgcccgctattcgggtttggccgccgcctgccagagaatctcggcaatcccctggcgcttggcaatcaggcgcgccgccacgaacagcaggtcggacaggcgattgatgtaggccaggccgaccccctccagcggttccacggcattcaggtgctggcagcgtcgctcggcactgcgcgccaggctgcgacagacatgggcttgggcaatcaaggccgaaccgcccggcagaatgaagttctccagcggccccaactcttcgttccagatatcgatggccgcttccaggcgttcgacttccgcggtattgagtgcctgatacaccggcatggccaactcgccgcccaggtcgaagaggcggtgctggcaaggcgccaggacgtcgatcagctcttgcaagccgggatgttctagacgctgttccgccagcccggccaggagcagccccagctggctattcagcgtatcgacttcgccgatggcctcgacccgcggatggtccttgggaacccggcgcccgtcacccagcccggtttcacctttgtcgccggtgcgggtgtaaatcttcgacaagcgaaagcccatgcttacctctccaatgggggatgttccagtggtggcggatgactgcccgccaatggcaaacgcaaggtgaagcaagtgccctggccctgcgtcgactgcacttccatctggcctttgtgattgttggtgatgatgaagtaagagaccgaaagcccaaggccggtgccctggccgatttccttggtggtgaagaacggttcgaaggtgcgtttgcgcacgttttcgctcatgccgatgccgttgtcctcgacctggatttccgcccagggcgggttcagccgggtgcgcaggataatgcgcccgggttcgctgtcatccacgcgctggtgaatggcctgggcggcgtttttcagcaggttgagcagtacctgttccagttcgttggcggtgccgggcaccggccccagttgcgggtcgaactggcggatgatggcctggcccttgaagtcgaagcctatggccaggtcgaagtcgttgccggcaatctccacggcctggtcgatcaatgccggcaggtcgcagggcgccatctgccggttgctgcgccggctgaaactgagcatatgggtcacgatcttcgccgcccgggcgccagcctgctgaatgccatcaagcagttgcggcacttcgcggctctgcaggtaacggttgacggtttccagctcgatgccgatctgctcggcatgttcctgattcttcggcagctcgggggacaggcgccgacgaatgttctgcacgttgtgcaggatggcccccagcgggttgttgatttcgtgagccatgccggcggccaggccacccacggagagcattttttccgactgcaccatcatttcttccagggataggcgctgggtgatgtcgtcgatccggatcaccacgccgcgcccggcaccgcccatcagcgggtagaaggtcagggcgtaatgccgggcttcgtcgtccttgacccaggtgacccgctcgaccttggtgaccgtatgttgctccacggtttccttgagttgcggcaggaacggcttgagcggttcgaaggcgaggaagatcggctgattcagcgcttcgtccaggcgggtgccggagagggcgctggcctcctggttccattgggtgacatagagctgctcgtcgagggcgatcagggccgagggcatcgagtcgatgatgctgttgaggtagttctgaaagccggtgagtttcttttcgatcttgctgcgcacctggacttccagttccagcttgcggttggtgtgacgggtttcctcggccagcccctgggcctggtcataggccgcctgggagtcgtcgcgggcccgcttgagttgctgttctcgcgcttcgatgcgcgacagcatggtgttgaaggcctcggccaggctgccgatttcatcgtggttgccacgggcggcgcgcagggaatagttttcctcgcgtgtcacctgccgggacagttcttccagctgatggatgggttgggtgatcagccgtttgatctgtcgggcaatgatcagccacagcagcacgctgaagatcaggatgcccaggctcgcggtcagggtgccggtgtagaaggccatcggcagctcactgctggccactagcaacaggtggccggggggctggccggcgcggggcagggtgatgatctggttgctgcgaaattcggtcagttgccaggcttcgatatgccgatagcgttccggcaggttcaggcgttcgccatgttgcaactgggccaggcgagtgcccttgccgtcatagatcgctgcggcgcgcaggggagagtagctgttgagttcgttgagcagcttctcggcgttttgtggcgagtccagcgcctgtgcggccagggtcgggttggataccagtcggccgatggtctgcaaggcttgcggcgccatgctttcctgagagatccagtaggcggcgctgataaaggtcaggttggcgaccagcagtacggtaatcagcaggacgagcaaggcggccagcagtttttggccgaccggcaggttttcaaggcgctggcgcaatggcatcggggacgtcgctagagaggaacacgtgggcagcgtagccgctgctcagtcgctgggcaatccgcactgttgcaggtgttccaccaatagccggcgcaggcggccgaggttgggcagatgcagctggtgcctggcggcaacgtcgcaggcatgccccaataagtagctgatttcggtcctgcgccggctggcgacgtcctggtacatggaggagtagttggcggcggtcgcctggatcacccgctccacttcctgctgcaggttctcggccgcggcgggctggccgcaacgttccagcagttcgctcagctcgacgcacagcatcgccacttcgcaatggtgctgcagcaggccgccgttgcggcagtcgtgcaggaccgtcagggggttgatcgcgcagttgagcgccagcttgcgccagaggcgggtcaggatatccgcgctccattcatgggggatgccgctggcgctcaggtcgtcgagccagaagggcgcggtggggtggctggcgtcccccagccaggtgtagccatgaccggcgaacaccacgcgccagtcgccatcgcgaaaggcgccttcggtgctcgaggcataaatgcagcgggcctgcggcacttgggcggccacggcgtcctggctgcccaggccgttctgcagcaggaccagttcggcatccggcgtcaggcgcgagaccagctggctgacggcctgttgcgcgtcataggccttgcaggctaccagcagacgagtgatgggctcagggctgtcgaccgtctcgccgggaatggcatgaaaactggtctgcccttgttccaccagcgtcagcccacccgcggcctggtaggcctgcaggcgggactgatcacgcaggatcaggcgtaccggcaagccggcccgggccaggcgtgtcgcccacagggtgccgaggctgcccgcgcccagaatgtgccaggtagtcgacatcagcgtggtgctcggtttggcaggcgcatgcgaggctcgcagtgaaggaggggaaagacccgttataatgagcccggattttaaccgcaaaccgggcgtgctccatctttatcgagctgcgcccctttttttattggagaaatgacatgccgtcgttcgacgtggtatccgaactggacaaacacgaagtcaccaacgccgtggaaaacgccgtcaaggagctggaccgccgctatgacttgaagggcaagggcagcttcgagttcaaggaaaaggaactcaccgtcaacctgaccgctgaagccgaattccagctggaagcgatgatcgagatcctcaagctggccctggtcaagcgcaagatcgatgtgcagtgccttgaggtcaaggacgcttacgcttcgggcaaggtgatgaagcaggaagccaccctcaaggaaggcatcgacaaagagctggcgaaaaagatcgttgcccacatcaaggacgccaagctgaaggtccaggctgcgatccagggcgagcaggtacgggtgaccggcaagaagcgcgacgatctgcaggaagccatcgccgccctgcgggcgaaagagttcggcatgccgctgcagttcaacaacttccgcgactgatgggatttttcgggaacctcgcgagtttattggcgtccgaggcccgagtagtgggcagaaacgattaagcctttataaagaaagctactcgttctgcccttgttttttgtgtgcccggcagccgggaatcaggagagatagatggatttgaatgctgaagtggacaacctggtcaaggcttcccaagcctggattccgatgatcatggaatacggcagtcgggtactgctggccgtcatcacgctggccatcggctggtggctgatcaacagcctgacgcaaaaagtcggcaagctgctggcgctgcgtaatgccgaccaggccctgcagggttttatcagcagcctggcgaacgtcattctcaaggtgctgctggttgtcagcgtggcctcgatgatcggtgtcgaaaccacttcgttcgttgccgcgatcggtgcggcgggcctggccatcggcctggccttgcaaggcagcctggccaacttcgccggtggcgtgctgatcctgctgttccgtcctttccgcatcggcgacgtgatcgaagcccagggtatcagcggcacggtcgacagcatccagatcttccacacggtgctgcgtaccggtgacaacaagaccgttatcgtgcctaacggcaacctgtccaacggcatcatcactaaccacaaccgccagctgacccgcaaagtgatcttcgatgttggcgtgaactacgaggctgacctgcaaaaggcccgtgaggttctgctggacctggccaaggacgagcgtgtgctggccgatccggagccggtggcggtggtttccatgctgggtgacagcgccattactctttccttgcgagtctgggtgaagaccgcggactactgggacgtgatgttccgtttcaacgagttgtcccgtgatcgcttgaaggcagcgggtattgatatcccctttccacagcgagtgattcgtgtggttcaggaagcggctgtttgagtaagtaacggggatagggattaaaagtctgatcgagtggtcaggcttttaatgcggtactcactggagagtgttgaaacctggttgtaacaataagcagtcggtaatcggagtctcagcgagttgccagctccaataaaaaggcccatcgaacgatgggccttttttattacttgctaagtaaccgctattacaagatcgacagtgggtagtcgacgatcaggcggaactctttgacatcaccttcggcttggtcagcgttggcagtgtgccaggcttgacgaacgcggaacgacaagtctttagctgggccggtctgaacaacgtacttggcttcgaagttggtttcgtggtgtttgccatctgcgccataaccgtaaagacggtatgggctgtcagcgtccatcttggtgccgtcgatgtcccaaccttttacatagcgggtcatgaagctcaggccaggtacaccgtattcggccattttcaggtcgtaacggatctgtgcggacttctcgttcgggccgttgaagtcagagtactggatggagttggcgaggaagatcgagtcgccaccacggttggagccgcgcttggtggtgtcgtggccaccgataccgatgtagtcgaatggcgtgtcaccattgaccttctggaacccaacggtaagggtgtgcgctttcaggaacgagaaggctgctgccagggagaatgtggtgttgctgatgtcaccagccttggcgctaccagagtcggtggtacggtagatgttaccgtccaggttcagcgactgatcgccacccatcgggatggtgtagttcaggttggcgtagtactggttccagatatcttccagcttggcgccgtagagcgatgcactcaggttgtcggtgatgccgtacttgccaccgaagtagtcgatgctgttggatgccacgccggcgtagttagcatacaagttgccgttacgagcgttggagtcctggctggtacccgaatagaagtgaccgccttccagatcaaggtttttgatctcgctgctctgcagttggaaaccgctggcagtttgaggaaggatccgggaaccgccgaccgcgaagaccggggaggtgcttggctgcatgtcgccgaatttcaactcggttttggaaatgcggaatttgacggccgcgcctgctttgccctggctgtcgttgacgtcgccatcggagtcgcggctcatgttgccggtgccgccagtgccgtcgccgccgtccagtttgatcgccagataaccgaacgcatcgatgccgacgcctacagtgccctgagtgtaaccagagctgaagttaccccagataccctgggtccagtccttctgatcattgttgcgatttttgttgtcacggttgaagtaatagttacgcagcagtacgtcgaacttagcgtcttcaacaaagcccttggcttcagactggtcacttacaaaaggtgcggccgtagccacttgagtactggcggctgctgcaactgccagtgcgatcatgctccacttcatcacgcgcatcgtgatttgctcctttggtttttagaagagtactgccgtcccacctgttttattatctgggcggctctttctttttgtgtcggcgcaaacttatatcacgccgacaatgttggcgatacttgcgtatcagtcctttcagcttctttacgaccctgtcgcaaaatgctcgatcaatgtcgcaaatccgcagtccgcatgtacccggactgacaacttcagcgctgttttcgaaggcttgaacctggaacaaaaagaactttggtcaagcagtcaaatctccatggggcagccttgccactattgttattagtcacaggagaggcctttttccggtggctcctcctgggacaatgtgggtgtgaatgcaacaagcgtgcacaaaacgcaaaggcaccgagtttttttcggtgatagcccttctggctgtaaaaaccgcataaaacagtggttttaaggtcgttttgtttgggcttgacgttccctgtcctcctggtgttgatccctgaaaaaaacgcatgacattccaaaacgttaccggttcaccctgctgagtgagtagatggcggatggttaacgcactgagcgtagacgcactgtgaggttttggtgcaaaagtttcttgatgcagctcaatcatcatccggcgtcgggcactggaagaatgcgcagggaagggcctctttcgcggttttctccttgttttttatgagcttcgttctgtcatggtgcagcccgctggaaaatgttccagtccggggcgctctgacgcgtggcatcgaggatgagtgttgaggcgggatctgcgcagcagagcgatgaacgcaagagctttcgcaggtatgctgccgttctgtcgcttggcgggcagccggtcatggcgttcgctaagctgaaacttgatgagctgagcgggagtacgcgcggtgttcgctttagatccacgacttcaacaagacacactgcccattggggatttccccctttgtcggctgctgttgtccaacgattccaattacccgtggttcatcctggtaccgcgccgggaagatatcagtgagttgtttcaattggatgacgcggaccagcagcaactatggcgagaaaccacggcgttggcggagttgcttaaagactcgttcgatgcggacaagttgaatgtggcgactctgggtaatgtcgtcagccagttgcacatgcacgttatcgttcgcaagcgcgacgatgcggcctggcctgctccggtatggggcaagctgcctgccaagccctatgccgccgaacaggtggctgcgattcgtgagcggttacgactggtcctgaccgatgatttcaagtttctggagggctgagtcatgaacctggaagagcgggtaaccgatctggaaagccgattggcttttcaggatgacaccattcaagccctgaacgacgtgctggtagggcagcagcgggtggtcgaacgtctgcaattgcaaatggccgccttgctcaagcgacaagaggaaatggtggggcagttcgaatcattcgaagaagaggctccgccgccacattactgagcatcgggcgaccggacgttcaggcaataaaaaaccgcgagcagcatggctgcgtcgcggtttttttggggcgtgaatcagcgccgcggcaacgccgcaatcacgtcttcggcttgcaggcccttgtcacgattcatgacggagaactccacgcgctggccttccaccaggacgcggtgaccttcgccacggatggcgcggaagtgcacgaagatatcatcgccggagtcgcgagagatgaagccgaaacccttcgaagtgttgaaccacttgacggtgccggtatcgcgattgctcatgtcgtaggtttgcgacgtattggtcgagggggacgatttatagaagctgacggccaggtgcagaagaacggcgatcgccgcggtcagcaggctgaacagcacagccggttgacctgcgataaccggcattggtgccagcagggtcaaggtctgcaagaccaccgccagcaccaggagcgcgctgaccaggttttgcagttggtgacgcgggcctttgttccagtaggggataaccggagccagtgtcaggttgagcaggccgaaaaaggccaggtaaagagcatcgggttgttgcaggaagggaacggcttcggatcgcaggctagggataaaggacagcagcaaggctgctgcgcccgttagcaggtggacgattttcaacattttaatgaactcacgttaagacggatcacaaggaagagctgagcgtgcacggttcgcttctgaacaatgggaggcggtgagcacgtgcgcgggatcagcctatgcgctgaggccgagaaataggcaacaacgacacggcctctatttaacagcaaagcccaggccttctcaaatcaggcgctgtggccgggaggagggagaaaaccctggttgtcctgagggaataccggactatcgggcaaagccttgttctagagagccagcgcccaaaaaagtggaacggcggctttccaggcgggtcacaaccggcgtggaccttcttgcaggtactggccgcccgcttggtgggcaatttgtcgcagtgcctcgggcaatcccgggctgcgggtgcagggcagtcttgctagagtggtccggtacctgacctgttgaattcaatgtactaacggagatagacatggcaatcgatatcggtatcagcgcagaagatcgcaaatccatcgtggaggggctctctcgcctgctttcagatacttatgtgctttatctgaagactcataatttccactggaacgtcacggggccgcagttccgcacgctgcatctgatgttcgaggagcagtacaacgaactggcgctggcggtggacctgattgccgagcgtatccgcgccctggggttcccggcgccaggtgcctattccatctacgcgcgtctttcttcgatcaaggaagaagagggtgtgccaagcgccgatgagatgatcaaacagctggtggcggggcaggaagctgtgacccgcactgcccgtggcattttcccgatcatcgacaaggtcagcgacgaacccaccgcagacttgctgacccagcggatgcaggtgcatgagaaaaccgcgtggatgctgcgctcgctgttgagcgagcaatagtcccgtagaccgaatggcgccgttatcggcgccatttgcctttatggggcgtgacttgtcgtctgatcatggctgttcgtcctcaggctcgatgagtggggtatggcagtggggcgctggctttgtttcggcgggcggtggtctatcggcgccgtcatacggctgcacagggccgatttaatggatataatcccgccctttgctatataacccgggcctcggcacgggttaagccagacgttaagtacgccgagacgctctcatgcccatgtacgactaccaatgtgcttcctgtggtcatcagctggaagccattcaaaagatcagcgcgcctgcgttggtcgattgccctgcctgccaggcgcccgagctgaaaaaaatgctgtccatgccaggtttccgcctcagcggttcgggctggtatgagaccgacttcaaaaccggcgccaagaagaacctggccggtggcgacaaagctgattaagttgaatgacacgcgcgagctcttgcattatccggtaccccgaggtgcgcaaggcctcccatcgaatttcgaattacgagaagtgaaaccactaccatgatgcgcagccattattgcggccaactgaacgaaagcctggaaggtcaggaagttaccctttgcggatgggtccaccgtcgtcgcgaccatggcggggtgatcttcctcgatatccgtgatcgtgaaggtctggcccaggtggtgttcgacccggaccgcgctgaaaccttcgccgccgccgaccgcgtgcgcagcgaatacgtggtcaagatcaccggcaaggtgcgcctgcgtccggccggtgccggcaacgccaacatggcttcgggcatgatcgaagtcctgggctacgagctggaagtgctgaacgaagcggaaaccccgccgttcccgctcaacgaatactccgacgtgggcgaagaaacccgcctgcgctatcgcttcatcgacctgcgccgtccggaaatggccgagaagctgcgcctgcgctcgcgcatgaccaccagcatccgtcgctacctggacgagaacggtttcctcgatgtcgaaaccccgatcctgacccgtgccacccctgaaggcgcgcgtgactatctggtgccgagccgtacccacgccggcagcttcttcgccctgccgcagtcgccccagctgtttaagcagctgctgatggtcgccggcttcgaccgctactaccagattgccaaatgcttccgcgacgaagacctgcgtgccgaccgtcagcctgagttcactcagatcgacatcgaaaccagcttcctcgatgaaaaagacatcatgggcctgaccgaaggcatgatccgcaacctgttcaaggaagtgctggatctggagttcggcgaattcccccacatgacctttgaagaagccatgcgtcgctacggttccgacaagccggacctgcgtaacccgctggaactggtggacgttgccgaccagctcaaggaagtggaattcaaggtgttcagcggtccggccaacgatccgaaatgccgtatcgccgcgttgcgcgttcctggcggggcgagcatgccgcgcaagcagatcgacgattacaccaagttcgtcggcatctacggtgccaagggcctggcgtacatcaaggtcaacgaacgcgccaatggcgttgacggtctgcagtcgccaatcgtcaagaacatcccggaagccaacctgaacgtgatcctcgatcgcgtgggtgcggtcgatggcgacatcgtgttcttcggtgccgacaaggccaagatcgtcagcgaggccctgggcgcgctgcggatcaagctcggtcacgacctgaacctgctgacctgcgaatgggcgccgatgtgggttgtcgatttcccgatgttcgaagagaacgacgacggcagcttcaccgccttgcaccacccgttcaccgcgccgaaatgctcgccggaagaactggaagccaacccggcgaccgcgctgtcccgtgcctacgacatggtgctcaacggcaccgagctgggtggcggttcgatccgtatccaccgcaaggaaatgcaacaggcggtcttccgtctgctgggcatcgatgaagcggaacaggaagagaagttcggcttcctgctggacgccctgaagtacggcgcgccgccgcacggtggcctggcgttcggcctggatcgcctggtgatgctgatgaccggcgcccagtcgatccgtgaagtgatcgccttcccgaaaacccagagcgccgcttgcgtgatgacccaggctcctggcctggtcgacgccaaggcgctgcgcgaactgcacatccgtttgcgcgaacagccaaaggctgagtaaggccgacctgaaggcgcatcttcggatgcgcctttttctattgggtcgagatatttgttgcccgcccgctgttacaggcgttgcgggcaatgtttcaaagagaatttggagcgcgttatggcaggtcattccaagtgggcgaacatcaagcaccgcaaagagcgtcaggatgccaagagaggcaagatcttcaccaagtggatccgtgaactgacggtcgccgctcgtcagggcggtggcgagccgggttccaacccgcgtctgcgcctggccctggacaaggccctgggcgccaacatgagccgcgacatcatcgatcgcgccatcgcccgtggtgcgggtgcgaccgaggccgacaacgtcgaagagctgacctatgagggttatggtccgggcggcgtggcggtgatggtcgaatgcatgaccgacaaccgcaaccgtaccgccgcggccgtgcgccatgcgttcagtaaatgtggcggcaatcttggtactgacggttcggtggcgtatctgttcgaacgcaaggggcagatcagcttcgcgccgggcgtcgatgaggacgcactgaccgatgcggcgctggaagccgacgccgatgacgtggtcgttcacgaagacggctcgatcgatgtgtttacctcgttcactggcttctatgcggtgcgcaacgcgctcgaagaggccggtttcaagggcgatgacgcggaaatcgtcatgcagccgaccaccagtgccgagctggatctggaaggcgccgagaagatcctcaagctgatcgacatgctcgaagatctggacgatgtgcagaacgtctactccaacgcggatattccccagtcggttgccgagcaactcggctgatagcgcgataaaagatcgcagccttcggcggtttcccccctttacgcacagggttacgctgtacctgtaggggagctgtcgaaggctgcgattttttgtttttccggcttctcccggcgttaccttaggcaaccgaattttctctttgcaggcgttatgactcttattcttggtatcgacccgggttcgcgcatcaccggttacggcgtggtacgtgataccgggcgtggttgcgtgtacgtggcttcgggctgtattcgcacgggcgccggcgagctgcatgagcggctgcaaatcgtctatcgcggggttcgcgaggtcattcagacctacggtccggtgaccatgggcattgaaaaggtgttcatggcgcgtaatgccgattcggccttgaaactgggtcaggcccgtggcgcggcgatcgtagcgggagccgaggagagcctggaaatcgccgaatacaccgccactcaggtcaagcaggccgtggcgggcaccggtggggccaacaaggaacaagtgcaaatgatggtcatgcacttgctcaagttgaccagcaagccgcagatcgacgcctcggacgccctggcgattgccatctgtcatgcccacacccgttccagcctgctgccccacggcctgggtaccgcacgcagtcgtggcggtcgcctgcgtctctgatagcatctgcgcaaacatttgatgagtggagtgtcccgcgcctgtctgcccggcccggatcttcgctctatgactcgccggcccctgttctggcctgagctaaggatctgaaacgtgattggacgcttgcgcggcaccttggctgaaaaacagccgccgtacctgattctcgatgtaaacggcctgggttacgaggtggaagtccccatgaccaccctctaccgcctgccgtcggtcggtgaaccgcttaccctgcacacccatttggtcgtgcgtgaagatgcccagttactctatggctttgccagcaagcgtgagcgggacttctttcgcgaactgattcgcctcaatggcgtggggccgaaactggcgctggcgctgatgtccagcctggaggtcgacgagctggtgcgttgcgtgcaagcgcaggacacctcggcgctgaccaaggtgccgggggtcggtaaaaagaccgcggagcgcctgctggtcgaactcaaggaccgcttcaaggcctgggaaaccgtaccgagcatgtttgccctggtgccgaaccagccggatgcgccgatgccggtggccagtgccgagaccgatgcggtcagcgccctgatctccctgggctacaagccgcaggaagccagcaaggccgtttccgcgatcaaggaaaaaggcctgagcagtgaagacatgattcgccgcgccctgaagggaatgatttaagtgatagaagcagatcgtctgatcgccgccacgggcccccgtgagcgcgaggaagtccaggaccgtgcgattcgccccgtcagcctggccgaatacatcggccagccgacggtgcgcgagcaaatggagctgttcatccaggctgcccgcgggcgcagcgagtcgctggaccacaccctgatcttcggcccgccgggcctgggtaagaccacgctggccaacatcatcgcccaggaaatgggggtgtcgatcaagagcacctcggggccggtgctggagcgccctggcgacctggcggcgctgctgaccaatctcgaaccgcacgacgtgctgtttatcgatgaaatccatcgcttgtcgccgattgtcgaggaagtgctgtacccggccatggaagatttccagctggacatcatgatcggcgaagggccggcggcccgttcgatcaagctcgacttgccgccgttcaccctggtgggggcgacgacccgcgcgggcatgctgaccaacccgctgcgcgatcgcttcggtatcgtccagcgcctggagttctacagcaccgcggacctggcgaccattgtcgggcgctccgccggcattctcggcttgccgctggacccggatggcgcctttgaaatcgcccggcgcgcccgcgggacgccgcgtatcgccaaccgtttgttgcgccgggtaagggactttgccgaggttcgcgccaagggccacatcaccaagcccatcgccgacctggcgctgaaccttctggatgtcgacgaacgtggcttcgaccaccaggaccggcgcctgctgctgaccatgatcgagaagttcgacggcgggccggtgggggtcgacagcctggcggccgccatcagcgaggagcggcataccatcgaggatgtgctcgagccctatctgatccagcaaggctatatcatgcgtacgccgcgggggcgtgtggtgacccggcatgcctatctgcatttcggtctaaacatcccgtcacgattgggggagatgcctgtggtagacgaattcctcgatgccgtggacgattaataaccgcttgagcagcgatttattcgcagcttgtgcggtcctagggggctggcattgtcgttatttcgccagaaagccgttcgagaatgaaaaacagttgcccggccggattggcaacctgaggagtaagcactagagtatgcgcgcgcaaaacgggcttgagtcgttcgcacatcgttgtcgcgtttattacgaagacaccgatgccggcggcatcgtgtattacgttaattaccttaagtttatggaacgggctcgaaccgagcggctacgagatctgggctttgcccaatcgcagctggcaggggagaacctgttgttcgtcgtgcattccagcgaagcgcgctaccacgcgccggcgcgactggacgacgagcttctggtaagtgcagaagtcatcgaattgaaccgggccagcctgcgcttcaaacagcaggtcaggcgagccacggataatgcactgctctgcgaagggcagtttctggtggcctgtgtgcgcaccgacaatttgaaaccccgggccattcccgaagctctacgtgcggccttcgccgacgtgagcggcgcgggtacacactcagagcaggagataaagcgtggaagctaacgtcgtcgaccattcctccatgtggagcctggtcagcaatgccagcatcgttgtgcagttggtaatgctgaccctggtagccgcatcggtgacctcatggatcatgatctttcagcgcagcaacctgctgcgtgccggtcgacgcgccctggagagcttcgaagagcgcttctggtcgggtatcgacctgtccaagctgtaccgtcaggcgggcagcaacccggaccctgattcgggcgtggaacagatcttccgtgccggcttcaaggaattctcgcgcctgcgccagcaatcgggcgttgatcccgaggcggtcatggaaggtgtcgcgcgtgccatgcgtgtcgccatctcccgcgaagaagagaagctcgagcagagcctgccattcctcgccaccgtcggctcggtcagcccttacatcggtctgttcggtaccgtctgggggatcatgaactccttccgcggcctggccagcgcccaacaggcgaccctggcgaccgttgcaccgggtatcgccgaagccctgatcgccaccgcgatcggcctgtttgccgcgatcccggccgttatcgcctacaaccgctttgcggcccgtggcgaaaccctgatcagccgttactacaccttcgccgacgagttccaggcgatcctgcaccgtaaagtgcacaccagcgaagagtgagcaggtaaatccccatggcccgagttcgccacaaacgcaagccggttgccgagatgaacgtggtgccctacatcgacgtgatgttggtactgctggttatcttcatggtgaccgcgccgatgctcaatcagggcgtgaaagtcgatctgcccaaggtttccagcgaagccttgccgcaggataacaacacccaggtcctgaccatttcgatcaaggctgacaagacctactactggaaccttggcagcgaagtcgacaccgacaagcagatggacaaggccatgaccttgccgcagatgaccgacgccgtgaccaagatcattcgcgccggcaatgaaggcggcaagcatacccaggtgttcattcgcggcgacaagtccgtcgattacggcgccgtcatgggcgccatgggcggactgcagaaggccggcgtcggtaacgttggcttgattaccgaggcgccctgatgcagcaacagcgagagccgtccgcctcggaaagctacttctggcctagcgtgtgggcaattgccctgcacgttctggtgttcggcatgctgttcgtcagttttgccatgacgccggaattgccgccgtccaagccgatcgtccaggcgaccctgtatcagctgaaatcgaaaagtcaggcgaccacccagaccaatcagaagattgcgggtgaggcgaagaaatccgccgcgcgccagaccgaagtcgagcagatggagcagaaaaaggtcgagcaggaagcggtcaaggctgcggaacaaaagaaagaagaggctgctcaaaaagccgaggaagcgaaaaaggccgacgaagctaagaaagcggatgaggcgaagaaggctgatgaagccaagaaagccgacgacgcgaagaaggctgcggaagcgaaaaaggctgaagagaaacaattggctgatatagccaagaagaaagccgaagaagaagccaagaaagccgccgaagaagaggccaagaaaaaggccgctgaagaggcgaagaaaaagatagtcgaagacgcgaagaagaaagccgcggaagacgccaagaagaaagctgaagcagacgaggcgaagaagaaggtcgccgaggacgcgaagaagaaagccgccgccgacgcagccaagaaaaaggcccaggaagcagcgcgtaaatccgccgaagataaaaaggcccaggccctggctgatttgctttccgacacaccgcagcgtcagcaggccttggcggacgagcagggcgacgaagtcgcgggcagtttcgacgatctgattcgtgctcgtgcggcggaaggctgggctcgtcctccttcggcgcgcaacaacatgactgtcgtgctgcaaatcggcatgttgccggatggtacggtgacttccgtgtcggtggccaagtccagcggcgatggtccgttcgatgcctcggcggtagctgcggtcaagaacattggacgtttgacagaaatgcagggaatgaagccgagcgatttcgctccgtatcgttcattcaagatgacattcacacctgaggatctagccttgtgagaaaccttcttcgaggattgcttgtcgttatttgctgtatggcagggatagcgacagcggatgaaaagaacattctggtcaccagtggcagtgaccgggccacgccaatcgccgtagtgccattcggttggcaagggggcagcgtgctgcccgacgacatggcggaaatcatcggcaacgacctgcgcaactcgggttactactcgccgattccaaagcagaacatgatcagcctgccgacccaggccagcgaagtcatctaccgtgactggaaggccctgggcgcccagtacatcatggtcggcagcattgtcccggcgggcggtcgcctgcaggtgcaatacgccctgttcaacgtcgccaccgaacagcaagtgctgaccggcagcgtctcgggcagcgtcgaccagttgcgcgacatggctcactacatctccgaccagtcgttcgaaaagctcaccggtatcaagggcgccttctcgacccgcatgctgtacgtcacggcagagcgtttctccgagaagaacacgcgctacaccctgcaacgctccgactatgacggcgcgcgtgcagtgaccctgctgcaatcccgtgagccgatcctgtcgccgcgcttcgctccggatggcaagcgcattgcctatgtgtcgttcgaacagaagcgtccgcgcatcttcgttcagcacatcgacactggccgtcgcgagcagatcaccaacttcgaaggcctgaacggcgcgcctgcctggtcgccggacggccagcgcctggcgttcgtgctgtccaaggacggcaacccggacatctatgtgatgaacctgggttcgcgtcagatctcgcgtgtgaccgcggggcctggcatcaacaccgaaccgttctggggcaaggatggttcgaccatctacttcacctcggaccgtggcggcaagccacagatctacaagaccagtgccggcggtggcggtgcggaacgggtgactttcgtgggcaactacaacgccaacccgaaactgtccgcggatgaaaaaaccctggtcatgattcaccggcaggacggtttcacaaacttcaaggtagctgcccaggatttgcagcgtggcaacgtaaaaatccttaccgacagcacacttgatgagtcgcctactgttgcgcccaacggcaccatggtaatctacgccacccgccagcagggccggggagtcttgatgctcgtgtccattaatggtcgcgtgaggctcccgcttcctaccgctcaaggcgaagtcagagaaccgtcctggtccccttacctgaactgacgcggcgctttacgttttacttaacacactggggttcattaggagtttcacgatggaaatgctgaagtttggtaagtttgctgcgctggctctggccatggctgtagctgtaggttgctcctccaaaggcggcgacaacgctggtgaaggcgctgttgatccaaacgctggttacggcgctaacaccggtgcagttgacggctccctgagcgaagaagctgctctgcgcgcaatcaccaccttctacttcgaatacgacagctcggacctgaagccagaagccatgcgcgctctggacgttcacgccaaagacctgaaagcaaacggcgcgcgcgttgttctggaaggcaacaccgacgaacgtggtactcgtgagtacaacatggctctgggcgagcgtcgtgcgaaagccgttcagcgctacctggtgctgcaaggcgtttccccagctcagctggaactggtttcctacggcgaagagcgtccagttgctaccggcaacgacgagcagtcctgggctcaaaaccgtcgcgtcgaactgcgtaagtaattcgtcatgcgaacgtgccgtcgtgctctaactgtcttggctctcagcctcgcgccgctttcggtgtgggcagcggttcctgtggtcgataacaactcgggctataacaatagcggaggcagttatccgccagcgggttatggcacgaacggcgcctatgccgggggaggggtttcgacccctgtctcggcacagggcgagctgttccagcaactgcagcaaatgcaggatcaaatcgcacggcaacaaggtgtgattgaagtactgcaaaacgatattgcgcgtatgaggcaggaaagcctggagcgttaccaggatcttgatcgacgcattggagcgggcggtgcacctgccgcgactcctgataattcttctgccggtggcgatgccagtgccgccggtgcagctgccggggctgcctcgcaagctcaagcggcaagcagtgaaccgggcgatccggcgaaggaaaagctgtattacgaagcagccttcgacctgatcaaggccaaggatttcgacaaggccagccaggctttcgccgcattcctgcgtaaatacccaaacagccagtacgcgggtaatgcccagtactggttgggcgaagtgaacctggccaaaggcgacctgcaaggtgccggccaggcattcgccaaggtctcccagctgtatccgaagcatgccaaggtgccggactcgctgtataagctggctgacgtagagcgccgcctgggccacactgacaaggtcaagggcattctgcagcaggtggtggcccaatatccgggtacttccgccgcccagctggctcagcgcgatctgcaacgcatgtaatcgagtttgagctgttttgaagaaacccgcgcttgccgcgggttttttcgttagaatccatgccctttttatgaaacacgcttcctgggattaccgtgtttgcgggattcctcgaggtgcctgacggaggcggacagcctgtttagctgttacgcccgtggcgactatgcaagacacattgagaattaccgaagttttctactcgttgcagggtgaaactcggactgctggcctgcccacggtatttgtgcgcctgaccggttgtccgctgcgttgccaatactgcgacagtgcctacgccttcagcggtggcagtatccgcaccctcgagagcattctcgagcaggtcgccggtttccgcccgcgttatgtctgtgtgaccggcggcgagcctctggcccagcctaatgccattcccttgctcaagcagctgtgtgacgccggttacgaagtctcgctggaaaccagcggagctctggatatttccgcggtcgatccgcgggtcagtcgagtgctcgacctgaagacgccggggtcgcaggaagctcagcgcaatcgttacgaaaacatcgaactgctgacgccgaacgaccaggtcaagtttgtcatctgttcccgcgaggactatgactgggcggtttccaagctgatccagtatggtctggagcggcgggcgggcgaggtgctgttctcgccgagccatcacgacctcaatgcgcgcgatctggccgactggatcgttgcggacaacctgccggtgcgcctgcaattgcagctgcataaatacctttggaatgacgagccggggcgctgatatgactgaacaagcacagagccaagttgccactgaaaagcgtgcggtaatcctgctgtccggcggtctggactcggccaccgtggtggccatggcccgcgccgaagggtatcgctgctacaccatgagcttcgattacggccagcgtcatcgcgccgagttgcaggcggctgaacgtgtcgctcgcgacctgggtgtggtcgagcacaaggtgattggcctcaacctcaacggtatcggcggctccgcgctgaccgacagctccatcgatgtgcccgaggccccgagcgaagggatccccgtcacctacgtgccggcacgtaacactgtgttcctgtccctggcactgggctgggcagaagtgctgggcgcgcgggatatcttcattggtgtcaacgccgtggactattcggggtacccggattgccgtccggagttcgtcgaggccttcgagcgcatggccaacctggcgaccaaggccggggtagaggggcagggattccgtatccaggcaccgctacagaacctgagcaaggccgatatcgtcaaggcgggcatcaagctcggggtagattacggcctgaccgtgtcctgctaccaggccgatgatcaagggcgtgcctgcggcaagtgcgatagctgccgtctgcgcgcggaagggtttgccgcggccggtgtcagcgacccaacaccttatttttgatttttttcatattgggtgttgaattctttttataaatcagtattatacgcgccaccacacagcgggtcgttagctcagttggtagagcagttggcttttaaccaattggtcgtaggttcgaatcccacacgacccaccattttctagcagtatttaaaatccgaaaggcccacgaaagtgaggattttcgggtttttttttgcctgcagaaacgtgtaggtgcggggctggaaggtgtttaaggcacaaaacatacttacagacatgcagccgtctgtggcgaaccatagtttcgagccgacgtgatgtcaatatggaatattgcgaggctcgggagcgagcctgtgcaactttgtcaactgggccctgcttagaatgcgtgaccctgtaggcatctagcggaatttaggttgagcgagctcctccagatctgggtctatgaaacccaatccagatagtgatttagtctgcatactcgttgacctgtcccagcttccaggtctgggttgaactggttcagctccagttatatgacttgatgccgaccctattgatcatcaatgtgaacaggactgaggtctcggatacctcatccaacgctgaggcaggcggaatccctaactcttcccaccaggttcctggtccatcccatgtcagttcgtggcttaagccggtccccactggaagtattgcctgttccagagtgaagcgttcagagctgatgcttgcgacgtgagtcagcagctttgatgccccagaatcaatatctggtggaggcagcagcggtacggtttcggaatcagctgggtaggccggggctgccgcgacctctggttcttcaagggaggggagaggctcaggcagagctggaggcatatgagccacctgagtcggcacatgttcatccacccgcctttcaaacgcgattgcaccctgcgacaggcttcgttcgtgcagcactgcccgcatgtgatcgtagtcgacctcgatgtagctgagggtcgtggcaatgtttgaatggttcagcaagctttttgtgaggtggatatttcgctccggctgcctcatgagatccgttgccaaggtatgcctgaatcggtgcggtgtcatacgcgttccaatttcacgggtcagtttgcggtacatcccctccacctggtcgatattcatctccctcgagcggtagtatctggaaaaccgatttacgttgaacaactgctcatctggctggaagccgatctcgtccgctgcctccaacaggcccaataggtgaggctccaggcccggcatgatggggattgagaactcacgatgggtcttctctgtgtcagcttgtaccctgatcagcctgttttcccaatcgacgtcttggtaccgtaatgtcaacagtgcgttcaatcgaatgcctgtgtagtagaacatttcgaatacggtgagccagaaccaggctggtgttatctggctgcgtttttttgtgtagcgctcctcggccacaagagatttgagccagtctcgagcttgcttgatggcatcacgggctacggtcttacttgcacgttttggtgggatgaccgtggttttcttgaatgggtttacgctggtatgaagcaatgttccctgctcaagagcgtacccccacacagtgcgaagatggtttgagtaggtgttccagctttgtttggacagtcctcggtcaagctctttacgtcgccatcccaaaattgagcgatggtcgatcgaatcgagcgagctgtcttctccaaagtgccgcatgaatgctctggtggctgcaagataaatctttgcgctggcgtgtctcaggtcgtgggtgaaaatgtagtcttgtgttagctcaaggggcgtgttcattccgctccctccgcttttcccgccatcaggcttatgcttgcgttgtcgaagggaacctcagtaaaaaccgtcaggggatctttcagcagatatcccctcagctgtttggtggttctagggccagtgacgttgaaggtccagatattcaggctcttcgcagttttctgatgcaacttctgtttctcgaagcttctctggacaagttgccaggcactcacattctgagcttttgcctgcgcctcaatctcaggaaactcctgcacgtaacgcttgaaaattccaggtgtgacaagcatcgcggtccccgatacggtatgcaccagtgctttggtgtcattgataatgattcggcgggagacgaggcctttcctaagccattgaacaaatcctttacccagctcgctgttgttgcccggaattggtgcaacaccatcggcaatagctaccgtttcacttccagtatcagaaggtggtactggctggacgtcttccaggccagaaggcacggtctttgccgcagaggattgttctaggtcactttctggttgtggtggcgaagtgatgttatcaagtagattcagcaaagcggcaatctcggttgtatcgctttgagttttctgtggaagtgagccttccaatggcgctggactggttgcatgggggggagtggttaccggttgctggcgaggcacgatagttggttgatcgtcctctggaatgtcgatatttccagtctcaacctctacggtgcctgcatacacgggaggtcgatcgtttgggtcattccagatcagcgcaggagataacttgagaagagtgaatgtctttctccagcctcgcccgttgtcgatcgtagccttccagattgttctgtcctgggcgttcgtttggatcacgccttgatcttgcagcatattgaaaaatggggcgttcgaactggggataccttcaatgccttgactcaggagataggcccgcagttcatcagccatcggcttgctcaccagccatagcgcaccctgatccaaccatccatcagacgggccgtcgggttggtttggtttgaatttgtcgcgtaccaggtagcgcaagccatccgccagcttccgctgcagggattgttttggtgcggtgagtgctcgtgcaggattgccaccaagctcttgtgcaacagaagcctgatcggcctggactactatttcaccaagagtgccggcattttcgtattggcctgccaggatgaaaaccaattcagcccacacctcagggaaaccactgagccagtccaaaatatctgggttcaggatctgggcgtaggtgagagctgcagcagcgccgtggagtttgtagttgcgccccttcacataccggaagcggtatgggtatttgatggggccatgccatgggtgccaggttttaccgctctgcagctcaacatgcacgtctactgcgattttgccgatatcgtgaagcagagctccataagcggcggccgctgtccaggcttcggcctgggctgactgggactctggtggtgcgccaattggcagtagataggactggcgaattttcagtgcatacgcaacgatttccaggccgtgatcgagcatacccccggaatgtgcatggtggtggttctcagaagcagggagcaactgaaccagctcagcatagcgttcgagtggcttgcgatagagatctgagaactgttgccgggacagcgaagcgcgctgccatatgttctccagcagtttttgcctgcgcggtgaatcgagaagctccgtagctgagcctgggcggatgaagccctggggggattgctccggtaaagctggtgattttccgcggcggaagagagagaacatttcctgctccatgaaagattcatggggcgggcttttccactatctggagagtcccgttcaatggaaaaacaacatccgagccttaacgcatttcaaaggcgatatgacatcattcagttcctgagtgttgccttcgcctggaaaatgactcctgctatgaatttgcttttctttgaggcggttcgatgatggccaggcgagaatgtctcgcaggttttaatctatggggataacccaccaatggagtaagcatgagaccaaccaagattgagcttctcctattaggggctgtagccatcccgctaattggatttgtgctgtacatggcagcgcaaattttgattcccggcttgttcattccaactggccaagagtgacgtgtagctcagttctattcaggggagggtaccaatggccatttcaccggctaaagccggccctttcaggtagggcttttacccttgtgaaccattccattcgctttcaggagccattttccttttgggccatttgcaggctcagtcctgggggagatgcaacctggcctccattgcgtcgtgcagtatcctaacgatctcgatgatttcgtcctcagcaagccgatagaagacgatatggcgagggctctggaccatgccatttgcagtggcagctctctttctggagtggaccaggtgaaagcttcttaatccgaacgcaacctcgtccctcatgctgctgccaatccgcgttggtacgagggccagatcttcgatcgcggtgcggatcagttcctgatacctaaccctggcgccggtaccgaaatgtacttgtgtgtgtttgagaatgtccgcgatatcagaaagggctgtgttagttatccggtattgcgtcatgctcagtgtttctcggcaactgcttgggcggcctgctcaccgatgtttgccaatagttggcccagatcgccggaacccgtgacctcgatgaaacgaccttgctccaggtccatcaggccaatagaggtggcgtttcgcagagcttcaagtttcgccgcctcctcggattctcgctgctccaagagacgcagcgcttcgcgcatgacttcactggcgttctggtagcgaccagacttaaccaggtccttgatgacatcctcgtgatggggcgtcagtacaacatttcgagtggccatgttctgctccagccgattgggaagggtggtgatggaaatggcatattatgccaacgcacttgcgaaagcataattttcagtttatatctgatagcaaggtgcctcatctttgaggctcaaaaggggcgcgtacaatggccgcacatacatcctcaggacttgcacatcgcgttggctttggccttggtcgagctgtatccgtcctatttgccagtggagcctcgcccgtgctctggcttgcgagagcagtgttggttgtagctgtagtgctcttcatgtttgcactgggaagctggctggctgctgcaggcatgacgattgcctctattgccaccgtcttgtgggcactgtcccgggtggatttgactgccaacaatcctgctgccaaccaaactgagctgttcggaacagacgtattcggacgcaaactgaactggcttggcgagctggaggtccctgatccgtctcaccatgatcagaattgaccaacacccagcttaagaagagggggccattggcccccttattcgttcctgtggtcatttacctttcagagcacctgttgcaaccccggcagcactccctcctgcttgttgcaccggttgggatccgcggctcaggcctccaagcaggtctcctgttttgacgccggcccagcccaaggctccaacccaaaaaatcggcaatatcacaaacatggttcccatgatgaagttgaggattgcgtcttgggtagcggtgttcagccccataaccgggtcaaagctgaggtgcggagaacccgaaccgtacaaggcatcgaggatggtgctgtctaccattctggccagttgaaaccagaagtctacaaagatcagtgtgaagaacacgatggacatcgtcatggcagtgctcaactgatatgccccgactactaaaaccattggtatgcatatcaccattgccatcttgaatcgccccggcttttgtggaggccgtttcgtttaagtcaggccgccatggcctgacctgcttgttgctggtggaagtttgcctcagcctccgcgggcgggatatatccgattgagctcagcaggcgttggtggttgtaccagtgcacccatttcaaagtcgccatctcaacagcttcgcggctcttccatgattgacggtaaatcagctcggccttgtacagcccgttgatggtttcggccaaggcattgtcgtagctgtcacccttgctgccaaccgagggctcaatgccgcctctgccagccgctcggtgtagcgaatagagacgtactggctgccacggtcgctgtgatgaatcagtccatcggcacggtgtggctggcgggcatacagggcttgctccagggcatccagtacgaagtcggtcttcatgctggtactgactcgccagccgacgatgcgccgcgcaaagacgtcaatcacgaacgccacgtacagccacccttgccaggtcgagacataggtaaagtccgagacccagagctggttcggacggtcggcatggaactggcgttgaacacgatccagtggacacagcgatttgtcgctggccaccgtcgtccgcacaacctgtccgcgccttataccctgcaatcccgcctgccgcattagccgctccaccgtgcatctggcgatcccaatgccctctcgctgtagctgcttccagaccttcaccgcgccatagcactgcatgttggtatcccatacacgctggtgatctccagactcaacacctcatcgcgttgagcacggcaacaacgcaagtcagggttacgtagttgggccgcatgcctgcggtaaccggacggggcgatctgcaaaacacggcagatcgactcgaccccgagacggtcacggtactggtcgacaaaggccctcaggacttggtacggcggtcgagttccgcctgggcaaaatacgcactggccagacgcaggatctcgttggctttgcgcagttcgcggttctcacgctccagagccttgatgcgctcgcgctcttcggtggtcggccccggacgctgaccggcatcggttggatgacggcgaatccagccatgcaacgtttgcgctgcacagccgatcttcggggcaatggcctcaatggccgcccactcggacgggtagtcgttcaggtgctccagaaccatgcgcacggcacgttcacggacttcaggggaataggtcgtagtctttctcatggcctcatcttctcaagagttgaggcctccacgaaacccggggcgattcagtcggcagctatttgcgaatcacgtttgcattgatgccgtggctgctcgcaacgttggaaaccgtggcgcccggttgcaggcattcctgcacgacctgggccttgaagagttttggataagagcttcattggcgcatggagatcctaagggtgatcgcgcccgctaaaaagtaggcgggccccctcgcccttaatgcaggagttcaaacgctgtgttcaccgggcgcttacggccagtctaactcccttgcatttattcgtcccttcgtcaagggcagtggcactggttctactgtttctcgtacgaattctaaagcaggtttcagcacacgctttctgctcaagtgtcacctttatgcgggaaatatgttaactcgatcaagccggtttcaagcacgaaaggtgggcagaaatatcgatatatcgtggcgctatcttttaccctcggagatttcgaaaattatatattgaggatcgcttggcatttggctaggtgtgatcgcagcgcgaatgcgcaggcaatgtatgaatagaacatggctttttctttgtgctgcgacactcaaaagtttaaactatttaagtgaaagtatcatgaaaatatgtaaaaatctgaatcggccatccgcgtactttgctggtctctcactcctctgggcatccgccgcgacgtatgcggctcctcctcctgcggcgattgcacctgctacctacgacgcaagttatgctactgatcagactactgcaataaacaacaacacagcagcaattagcaccaacaaaaccaatattactaataacacgagtgccatcagcgtcaataaaacagatattgccaccaacaaagccaatatcactaacaacacaagcgccatcaccgctaacaaagccgccatcagcaccaacaaaacagatattgccaccagcaaagccaatatcactaacaatacaagcgccatcaccgctaacaaaaccgccatcagcaccaacaaagcagatattgccaccagcgcagccaatatcactaacaatacaagcgccatcaccgctaacaaaaccgccatcagcaccaacaaagcagatattgccaccagcgcagccaatatctctagcaacacgagcgccatcactgctaacaaagccgtcatcgataccaacaaggcagacattgcaagcaataaaaacgatattgctcaaaacgccgcagtcattaccaccaataaagataatattgcgcaaaattcgagcaatatttcagccaactcaggtagaattgctcagaactcaaataatatcaaaagtaatgaaggcaatattggtggcttacaaaagctggtggcaagaaatgcttctggcgatacgatagtgaaggcgagtgacggaaacgcaagattgactatttctaatgatgccacagttttgaagggcgggagaaatagtacgtatttgacactaagggatgatcgggcgcaattttcgaatgggaatggtgcgccgaccaaagtcaccggtatcgcagatggggttgagcaatatgatgctgtaaacgcagggcaattgaatcaggagaagagagaccggaaagaaggtgatcgaaaatcttatgccggtattgcgggtgttgcagcaatggctaacattccaagtctcagaggcaatcaggacttttcattggggatcggtctcggaaactttgagagcgagacggcgaccgctattagcttcgataccaatttgggtcatcttataggtgtaggtaataataactctctggcgacacgagtttctatgtcatacgacacgcaacataatacaactgtcgggcttggcgcatcgtttgggtggtgagcactgcaggtcctttcgtagaaaggaggcgctggaaaaagcttctgaatctcatgaagaactccttttaaccacaataactcttatataatctgcaagcgagaaatctggagcggtcgtgtcctcgatttttcgtatatatctagctagtaccggcctcaagtcggtgcttaatgagatggtcagcctgaccgagaagccctgcaggtttacgcttgcagggcttttctcgttttcggccggaggatctctcatgagcacgatgcactctttgcacatgtctggcttgggcgtcataagctcgattgcgcttgtaatacgcctgctgtgaggtgcctagaaactggcaaatcctcgtaatgtttgtagtggtcaactaatcccggacacgacgttaagttttttctcggcccgagctggcgctagtccgccgttgaattggtgtggtcgaatccagttgtaccgatgcatcaaataatggctgatgtcccggtgcgcttcttgggttgtcatgtagccctcagtcggtatccattcagttttcaggctgcgaaacacgcgttccatcggcgcattatcccagcagtttccccggcggctcatgctctggcgcatgcggtaacgccagagccgttggcgaaactgacggcttccatattgcgacccctgatccgagtggaacagcaggccttgaggcctgccacgctgttcgtaagccatgtccaacgccttgataaccagatccgcatccggcttgttcgacagcgcccaacccacaattcgacgcgcgtagagatctagaacgaccgccaggtaatgccatttcccctgcgcccagatgtaggtgatgtcgccacaccagacctgattgggtaccgatacctcaaactcccggttcagggtgttcggaatatcaggacgctcgaccgtcgcttgtttataggcatgtgagccaggttgtttgctgactagttccagttctcgcatcaagccacgtaccttgaaccgcccgatttgctcgccatcttcctgcatcatcgacacgatactgcggctgccggcagcgctgcgactttgcgtgaacagttcgttgactcgactgcgtaatcgaagtcgttcaacgttcggagttcgacgtctgaggcggtgggcgtagtagcacgaacgagtgatttcaaagactgtgcaaagccaatcaaccggctcttgtgcactcaactgatcaatcagcgcgtgcgctcgtgttcttccgacatcaagagcgccgtagccttttttaaaatggatttctcccgctcaaggcgagcaattcgagcttccagttcctggattttttgctgttcaggcgtcagcgccttgctctgcggagtaacgccggtgcgctcctgctgaagctgattaacccagcgacgcaacgcggactcgacaaccccgagtgaacggcaggcttcgatatggctatagccttgatcgagcacgaggcctgcggcctcgcgtttgaactcagcggaaaaggaacgacgttgcttggtcatcagacacctctatctggcgagcattctcgcctaaatgggtgtccggtttcattagaccactacagttcaggtcttcgatttgcccttgggtggggacttgccggatcgcttttttacgacagaaataccgtaatcgttcttcagcacgtcaacgacagcttcaaaaaatagggctttctggttggcaagggccagcttttcttcacgctccttgattcgctgctcaggtgtcagcggcagttttggctcgaccatcggtcggctcctgtgggcacgaatagaggcgccttggctacagtcctgtcgtccgtgcttgcgcaaccacaccagcacagtcgagcggcccggaatcccataacgccaattcctcgttcatcacaagatcgatcgctccatgacgatcaagcaaacccccatgatctttgaacggtagggctcatttttgacacgtcgatacaaaccatcgacacgtttctccaactcacgtcatgcacctgcgctgggcgagctgaatgcggctgatcttcagatcgactcgcaagtgaaccgatagtgatgacacttattgggcccaacactcggcctgaaaggtcggcgcggtgttgtcgtgtgatcaaggcgggcaggggctgggcgcagtcttgatacgttgacctgtcgatcatcaagccaccgttggcgccccaattgatgagggttaggcagcgttaaatatcgacccccatccattcgatgacaaggattgccctactaggaatgaggcataggcctacattatccaggggcgggtcggagggagagtttgcagcacgagatacttcagaccagcaggtctggagttaagttgggagtggctcacatgcgttcctccagtgctattcctgttcgagcatgccgtactcaccctgttttgcccatttctgctggcgtcctagtctgccagaagacgtggctgcgcgccagcctgctcgggctaggcatcgccacaagctatttccctctggcggccaatgccgtcttgacccaagtgatgacccagcgcgtggtggtgcatgccgtcgccgtggcttccgcctgccgtgtggtggtggagggcgacagcgtaggcagtaaccgcctttccttcggcgtttacaacaaaggcaccggcaatgcgcccgtagcccgccccctgaccttctggctgtacgaagaaggggccacgattccgggctgctcggccttcctggtgtcgccgctcgcctctgtacggttcggcaaccttggccagctggatgcgggcggggtgataacccgtggcgcaggtggccatgtgcgcgtggatatccgcgccgccgatccacaggccgactatcgcggcgcgattacggcacaaagcgcccaagtgaattatccctccgcgtttgctgcgcaaggacgactggcctttctggccaaaccggtggcgttggagcaagccagcgccggcgagtaccggggcaccttgtcttttgtcgtgacttacaactaaggatgatggcgtgagctctagcaaacgtgcagtcagccggtcccgtaagctacgcggccagttgtcccgcctcagtgcgttggcgttaatggtggccggcgcttcgtcgcttcacgcggccgatgcggtgacccctgtggcggcgcccacccaggcgccgaaaaacagtggcagcggcaagcttgatttctcctttattcagggcggtaccggcgtggatccatcagtttgggaggcggtgaacagccagtacattcccggccactatctgctggatgtgttggtcaatgacaagccccccgtcaagcagacgctcgatatcacgccggctgaccgggacgccttgtgcctcaaaacagactggctgattcgcgctgggatcttcatcgataccgcgtacttcaaggatacctataatccggagcgcggctgctacgtcctggccaaggctccctccgtgagcgtagacatggacatggcctcccagacgctgacgctcggtctgccgcaggtggcccaggcggcctcgccggaagatgtcgactgggactatggcaactcggcgatgcgtgccaactacagcgccaacgtcagtgccaacgacgtggacaccagcacctttggctcgctggacctgaaaggcaacctggccggatgggtggtgacctccaccatgaccgccacgcaagaagataccgatgtcgcgatgttcaccgccagccggccaatcaagccgctgcaagccgatttcctggtgggcaaaacctttgttggcgacggcctgctgggcagtgccggtgtcatgggcagtacgctgcgcagcaacagcagcatgcgttttaacgatatcggctatcgcccagtgttcagcggcgtggcgcgaagcaatgcccgggtctcgttgatccaggccggcagtacgctctggtcgcagccggtaccgccaggccccttcgccatccgcgatgtaaccctgctgaccagcggggacgtggaaatggtcatcaccgagcaagacggctcggtcacccgccaggtgttcccgctgaccgtgttgaccggaatgatcgcgccgggcgaacgggagttctcgacctcgctcggtgtgcgtgacggcaaggacgatgatcacggtgctgacggcggcgtgggctcgctgagctacggctacgggctgggcaacctgacgctcaggggcagcacgctggtgcaccgtgacttccagggtgtcagtgccgcaatggctaccagcctgggcgctctgggcggggtctccctcggcagcgcctgggagcaggccatgtacgacaacggggagacagagcatggcgtcaagctgcaggccacctggaacaagaccttcagcagtactggcacgaacgtctacctgaacctgtcgcgcgactcggagcagttcaccgactttgtgtcctttacgcccggccgcgatcgtcgttgtaaggtgcaaaccgatttcactgggtttgtcattggccccggtggtattccgctgcctggtcagttctgcctcgatggcatcgaccgccaaaaccgtaaccaaatcaacctcggcttcagccagggctttggagcgctcaccaccggcctgaccggctggaagcgtgactattggaataactcgtccaccgaaaccggcatcaccggcaacctgagcacgcaagtgtatggcgccaccgtctccctcggcggctctctgagccagagccgtaatgacaacggcactcaggacaactggtcggcctcactctcggtgtccgttccgttttcggtcggtgaacggcgctacagctcctggaccaccgcgaccaccggccagcaaggcggggttggcgtcaccagcgggatatccggttcgctcaatgatcggttgagttactccgtgggcggtggtcgcagcagcgatggcgcggcacaaggcaccgtgtccggcagctacaccggcaaccgggtagggctcggggtcagcatgacccagtcctccagcagtactaccggttcggccactgtgacgggctcggtgctggcactgccggttgccaggagcgtgatcttcagccgaacggtgagcgacaccgtggccgtggccaacatcaaggacacccccggcgtgaaactgttctccggtgtcgatgcgaccgaccaggccggcaacgtggtgataccgctgagcgggtatcgctacaacaccgtgacggtggatgccgccaccctaccgcataacgtggagctgggcagtaccagccagggcgtggtgccggtcgaacaagcagtggtgtacatgccgttcgagacctggaaggtgcatcgctacctgttgcaggtgcgcagagccaatggcgagttcgtcagcagcggcacctgggcgaaggatgagcaaggttcgccactcggatttgtggcgcaacacggtgttctgtttatgaactcagtcacccagccaggtgatatccaagtgggcgactgtcgtgtgcccgccacgaaaatcaaagagacagagaaggttcaagaggtgatttgtgaataagagcatccatcagcaggacgtcgccaataaacgcatgcagtggtctttggctgctctactgctggccgctttcctagggccagtatcttcggcgcacgcagcactggccatggacgccacccgctacattttcccgggcgacaaggattcggtggcgatcaccgtcaccaacgagagcaagaagacctatggggggcaggcgtgggtggacaacatcgtcgagaaggacacccgtccgaccttcgtcgtgaccccgtccttcttcaagttgaaggggcagggcaagcaggtcctgcggatcatccaggccaacgacctgccgcaggatcatgagtcggtgtactggctgaacttgcaggacatcccccccgcgctggaaggcagcggcctggcattggccctgcgcacccgggtgaagctgttctaccgcccggcggcgctgctgaaaaaccgcaaaggcgccgaggccggtatgcgtgtggaaaccgtgccgggagcgatggcgctggtcaacagcaccccctacatcttcgtcatcagtgcggtgaccgatgccagcgggaagccgttgaaactcaccgccgaggcggcagacaagctgctgatgttcatgccgggtgggcgggtagtggttccgccaggtatcgccaaggttgagtccgtggatgactacggcgcggtgaccaaagtcaccttgggcgcaaagagcgagaagtgatccacatgaaagcatatggattgatagcgttgctgctgatggtggtagaccagggagaggctgcgcaagggtatgaggagcgaaacacggacctggggcttgtgaatggcgtcgttcgtcacgatcaggtggtcgaggcgcaacgctccctgtccaacccggtgctgttcgaagcgaacagtcagagtgctccgaacatgccgactctgctgctggtgcgtcacgcccaggcagaggacggcggtggcggcgccatcctgctgaagcaaacgcagcagatgccggcgccaggtggccagcccgtcagcctgggattccaaagtcgcgtgaagttgtgggtgaacggggaagcggtcaatgcgagttaccgcacccaaggttcggatgtggtgatcccgctgccggcaggcgccacatcggtgtcgctgcgcagcgatggcccggtttcgttgctttaccccaaaagttaccggggagagctcagcctcgcgctggaaattgaagggtggcaggagacgccatgaggagccagctctgacggcttacttcgtcgagtgaaccgtcagacgtggcgcttgatcagcgtcacaacaagcacagcacccacgctgtgccgaatgagcaaacactactgatatcaggagcaacaaaatgaacatgaaccaatctctgctggtagctgccttggctgcagcaacttttgggggagcctccagcgccatggcgctgaccttcaccgatggcggcttcaccggcagcgtcgacatcagcggcaccgtcgacgttcccgtgtccaccaaccaatggcaatgggctaccggcgatgccatcagcttcgcttccatcccggtcacccggatgaccaatagctataaaaccctgaccctgcccgcgaccgccaacctgccgctgctggtgggacagaccaaggcggcgactattggtaatgcaggaaacgtaggtatcaacccacagattgccttcacggatgcggccggtgccaccgtgaccccggtgtgggagaacaccgacaacaccggtaaaggcaccatcaccctgccggtgactgcagcggatggcaccaccgccctgggcaacatgaccatgacggtgaaagtcggagccgtaagagcggtagtgacgacggtaaataactttttagagtcaacacatactacaaacactggtgtggagctgtatggtggagttgctcagccttccgcggcagctggggccttggcgacaggttcgatctccgcaacatggaatgctgctctgggtgccaagactgatacagatctacgtgatcaactgaatactgctagcggcttaagtttgactacatggggtagtgatagttcaaccgcagcatttgggtttaatgcacctagcgagtactattctggcacttacggcctcggcatcgcccaaggcgataacatcaccgtgcacttcaccaaccctgttaccgtcaataccacctggaaagcgccgctgaaaatgacggtgacttacctctaatcgcgcaacgaactgaaaaaatcaaataaagatagccaacgaaatcgcggagttttttgcaaaaaatggagcgaactatcttttacttaagctaagggagttgtccatgaaaacgaataaactttatatggcagtggccgcagtcgccttagggctctcctcccacgccatggcgctgaccttcaccgatggcaacttgaccggtggtgtggacatcggcggcgatatcgcggtgccggtcgctaccaaccaatggcaatgggctgccggcgatgccatcagtttcccttccatccacgtcacccagatgaccaatagctataaaaccctgaccctgcccgcgaccgccaacctgccgctgctggtgggacagaccaaggcggcgactattggtaatgcaggaaacgcaggtatcaacccacagattgccttcacggatgcggccggtgccaccgtgaccccggtgtgggacaacgctgacaataccggtaatggcaccatcaccctgccggtgaccgcagctgatggcaccaccgccctgggcagcatgagcatgaaggtaaaggttggagccattggagcgtactcaacctctaatgggtcggctatatactcaacctattcaacaactggcgtggagctgtatggtgcggctgctcttccttcttcagctgctggggtcatgagcacaggttcggtcgctgcggcatggaatgctagtcttgggagcaagactgctacagacttatttggtcaaacgcatacttctgctggcaacactagcactgcatgggataaaaattcgagcgttagcccatttgtttttaataatcctggttcgtactattctggcacttacggcctcggcatcgcccaaggcgacgacattgtcgtgaacttcactaatccggtcaccgtcaccactgcgtggaaaagtgctctaaaggtgaccgttacatatctctaaccaggtagcctatctctggccagggaaggccggaaataacgtcctgaattgcatgccatggcgtatttgttttattcatgccgtaatccggcttaactccaggcaggagcaagaataaaaacgcgatgacatacatacagatgctctctgtgcactagcattttttagtgatacccatgatgctgattattgttgttccggaccggaaaataaggatcctgccatgacccgtacaggttttctgtgtttgttgctgtcctgcgcagccagtccgacattcgccgctatcctggatcagggagaggtggagttttccggttacgtgatcgatgaggcgccgcgctggctttggcaggtcgcctctggcgatcagacctgggatgtcgacgtggccgatgcccacctggacgcgcagggcaatcaggtttttcctttgccaggcaaaggcacgctggccttcctggaaggtcacctgaaaaaggtcgccgaccggggtggtgccggcatgacgccggtcatcagcttctcgtccgaaggagcgccgctgaccacgctcgccggcgggggcagcccccaggacagccactggcaaacctcggtgccggtgcgcaatgcccagaccggggagcccgccgggcaactgtcgttcaccctggaacagggcatggcgctcgcccagggcgcggccttgtccaccctggacggtggcactgaccgcaagctcggcctcgccggcatggccctggtctccggcgagggtggacagagcggtgacgtaccgacggcgctgatgagtcgcctggcggtgctgatgggcatgaacaacggggttgaagccgcccgcgtcccgctcacctggcaaggtgagcacatcgcccgtcaggtgctggcggacagccacgtcccgctgctggcggcagcctatgcctcgcagttgtcgaatttcacactctcctggccacaggacaaggtgccctcccgctggcgggcctcgctcaatgtcaccgtcacgctccgttaagaccagaagacgaggagaacctgatgcaacactatgccgtacgcaccgccacaagccttgtcctgctcgccgccagcatgaccgctctggcccagtggcaggaaggggatttcagtggtgaactcaactggcggggggcggtgacccaaaaccgtaacccttgggcatgggcgcagggcaccctggacgacataggcgccctcactcagacccggatgcaggccgagggccgtgaggtggtttggcatgacctgctcaaacaaacgccccttctggtgggcaagatccagcagttaatgcccatgggccgtgcgggggtcagtccggtcattcagctaggtcaagacaacagggagttcagcctggtctggaagggcgctggcatcgcagaagtgacgctcccggtcaccgacaaagaggcgggcagcaacgctcttggtactctgaccttccaactgcgtgtggcggggatactggcagctaccacaggggtgacccgccgcggatacggattggttgccactgacgcgcaggatggcaatggcgttcccccgtcgaccagcgggctggcctatgacgcttccgtcgcggtcttgcaggcgatggccggctcggatgcgccgacttggctgtcgagccgactggccgatggcggcagtatcgccttgaacgcgctgcacaatgggcaaaatcaggcagttggggccatgtatggcgccgaaatcctgcccggaacgggcagtctgcgtttcccggcgggcaaggtgccgaagcaatggcgggtttcactgccaattcgcattacctaccgatgatgactgacctgacgggtcattcgaaatcagatccaccggccgaacggaatccatccagaaacgagatgacggatttttccatccgtatgaccgatttttggcccaggtgacgcttcgtcgcccttttcttcacctgcaagggatcgatgcgttttagttcgccaacatggctttgagtgttatggcactgccgtcgtagcaaaagggaagaatcctgctgagaagactacagccaaccccgttggatcgtagctcaaatctgctttggatcgaaaaaaagggtcaaattccgtccatacagcaccaagacgcctcctgtgaccggcgaagggcaggcgcgtcttggtgcctcatcctaagtaagtgtaagtgaacggaccatttacaaacacgtttgccgctgtgaggccggccttcggagttgatccgcgtgcgacagtgcgatcgatgctctcggcagacctaataggagcagggaagttttttcatgatgcgaacgagatagcctctgtccacttcaatatactctccctctttaagcgcttttacgattgccaatgcatgggatctggaaacacctgttgttgtattgataaaagatatcaaagtaaattttgccttgatggtggcaggaagcgagtctacccattctacagaggcctttatttcttcataactgtcattggtgcattgagtgagccactttctggatacttcggccaggtgtctggttatgaagtcgaataccccatcaatcagacgaggatccagcgtcgaaagcgaggaggagttaatagggagttcataatattttgtccgagaaatgattttatattgcgtagactcctccattttttcaaacagcgctttttttagccagaccagcccgccggcacagacgatgttaagggttttttgaccacctacaaacatttgccaagcgccatcctcaatataaacgatggatttgttttcggtgctgaatatggcctctccttcatcggcccacttgagtgttccaagcttgtaaatccaggtgcgcaagtagtggaggatatcgttcgatttggggggtgaacaaacactattatcttgagagttggacatgatttttatatttcctattgcttcaggcgattgatgcaatggttacgcagcagacgcctttctggtttagccctccccctaacaccatttttgccgagccaaacgcagcagaaatgtagggcattaataatccaaaaagcgtcacaagctcaagggcggtctgatattagactcagtcaagatgtgggcttaacagcggcgccgatatttgtcggctggatgatcaaaattgcttttgagtacttatttcagcacgtttaacgatttttgactcattttaaggtgttggcaggcgtggccaccgcttgcttgcatggaaatagctattgatttatcagtctggtctgccggtcctcgtttcaaatgttttttgaagcatttaaaaaatatctttaaatgcctcaaaaaagtaaatagccattcgctcaatagcgctgcctgtttactttcagacgagggccgagcgacggaaagacgaaacgccggtatataagagaagtgcgtgagaagtgcgtgagaagtcgtctcgtaaacccacgtccgcaacaggggctttaatagaagcgtctatggggactgtggctgtcgtcatcagcgtgctcagcgtcagcattgccattcgatacctcaggtggctgaggatcgttcgtattgaggcagctggtttgaggtactcacgcagatagatgagctgtttcagatcgccctaggctctgtacgaaatccgctgaaactcatttgactcccgcaaacgtcaggaatcagtagagtccgcgtccatcaaaggcaggagcccacgatggctaaacggtacgaacttcccgacgcagcctgggatttggttgcagacatcttcagtgaaacccgccgtaacggacgccctcgggcagacgatcggctgatgctcaacggcgtgctctgggtgctttgttcaggcgccgcctggcgaccgtcagcgcaacatcatcgagcgtatgtttcaggttcgttgttgaagcggtttcgcacccgatgatgttcatcaggcgcctgagtacggcacgttcggcacctgcagcggagcaaggcaggtcacgtcgagcaagcggaccggggcgttgggtgcaagcctgaccgctaaggcgggtccagcctgcccattacagtagtgcctgagttcataagaggtggcgcgatcgattgccggtaattgaacaaggttcatacggtgtgcccagcccttgtcaaacaggtaactttcagctacttaatcgatgcactgatttatttatatcatctacaccctcgggagaggctgtttttataaggccatgaagttcaaagtctgccgatagcacacctactttcaattatgcataaagctccagtatcagacttcatcttgtcatggtagggcgggggagatataaattaactgtgctcgagctgggggggtgaagtggtttatcaatggatggctaatacaccttggcgttttgcatggagcaatacactccacgcttatcatgccctcagcttcgagccagatgggaggtgtttacaccgccttctgaggatcagcagtggaggtaaagaaaatggaggagcatttacgttcagctatatatgtcgcaatcgctgcacttggagggatgttaggccatatgatgcgacggcggggagtacaagaaccgatcaaggtgggtgaaaccttgctgcaaggcgtcggtgctgcttttgcaggctatttggtgttattggcatgtcgctcatcgggtattaacccagatgtcacaggtgtgatcattggtttatgtggctggctgggagccgacgccacgttggtactgctgcaagactatatttacaagaagatcaaagtcggtacgccggttcgggatgtaccaaaagataagcaataaataaacattcgaactgccgcagtggcaaaaaactccgtggttggctacaaagaccttagcgcgaacacacacggcagcagtggtgtggactagggatcaaccctgctgcaggaattttaaaggttaaacaagtatgtgcaaaatgcaaccagccaaagagctcaatatgattggcgggattgtctgtcgattgagtttgactctcaaggtgtgcgttgacacaggaggtgatgagcgctcctctctccacaatccgctgctttccctgtttcttactcaataacctctgcgcacgttcgacagcgagtcgatggcggtctctgggcgtcgcctgtcaattcgactggtgatatcacttgcttcattactgatgatttttataaggatggtgtcttatgatgattaccgagttgcaactttccaccattctgtcgcgctctggccctgcggccaggttgtttacaccgttattaaacaaggcgatggactgttatgagatcaacaccagggaacgtatcgccgcctttattgcccagatcggtcatgaatcgggcgagctgcactacttgcgcgagctgggcagcgacgcctacttggccaagtatgacaccggcagactggccatgcgtcttggcaatacccctgaagcggacggcgacggacagcggtattgcggccgtggcctcattcagattacgggcttgagcaattaccggcggtgcggtgatgcgttggagctcgatctggtcaatcacccagaatggttggagcagcctgaatacgcctgcctatcggcggcctggtattggcacaacaaaggcttgaaccaattggccgatgaaggcgacttcgaagcgatcacgcgccgtatcaatggtggcctcaatggacaggttgagcgagtggccttgtatcaactggcgttgtcggtgttggcatgagcgcactgctttatgtactgctggtgatgaacgcatccagtctgggcgctttcgtaaccagaacctggcaaatcattcgaggccgacacaccaagcaagccaagcgtggacgcaccatgacattgaagttctgatcgtcaaccaccgtttgggatcaaaagccgtcgcgctgtcggcggcttcttttatttcggggaaccatcctgagcgaaaaccgcttacgtcacccgccagacagcgcggcggtgtttgcgccgatgcgcgtcatcccatcctttggcaacaaagagcaggttgtccagagactaacgcccgcctgatgtcagaccgcaccaatcatccaggtgccctacaaaagctgcatctgctccacggactgcgccgattcttgactgcctctttcgactcaccgtcagcggtgtaaatcgcagacgccatttgatctgtgggctgtgcgagtgcccaatctctgtcaatgcaaggtcttctgggaagggggcggaaggcgaaaaaccttaccggttaatctgatccaactttgtaaagtgagtccttgtctcgagcgatcggctcaccccggcgaggacattcggcttggcgaaccgggggaacgataaacgtcatgcccgttgcaggtaacgtcctctaacaattgtaccgcaggtttgatcccctcactcgtttataagggagccccgcgcatcatcgcgcgatcaaataccgttaaccaaaagactgatcattgtgatgaaaaatggatcgaatgcaggcccaggccccatgcccagtgttccctctccagcaagagcgaacacaccttctgccaatcaacaacgcaggagcagcaagattttttccgcgatcgaagaccctcaggcgttttcacccggtacgctggtaccgtctgcgcagccagcacccactcccccaaccaagcctgcgcctttctcgattcccagaacctgtggtgcatgcggcacctaccaccagggcccctgtacgatcttacgtcctcaggaagtatcctgcgtatccaaaccccagtcagcgctggaggtgtttgaacggtacaaaacgaactatcagtcacaggatcgagcgcagccgtttgaaatgatgcgcttgatcaccgatggtcgcctgaggtttgcccatcagcgcgcgagcgaagcggcgctgctgaaagtggcggacaagaaattcaccctgcgccactacaccacctcaaaggacggcccgccgccattcaacaccatcgcttcaaactttgagctcgtgcaccgccagatcaagacattgcaaagaacccaagggagcaataccaaccaggatgattgggtacggctggggaatacggcgtttactttctttctcctggccatcgacggccaggtcgcccaccgcaagttccttgccggagcaacgcattatgcggaaattgaccctcaggatccggcgcagatggcggcagcgggcctgagtgaggcagagttttttgtttcgcctgatttgttgcacgtcaaggatctatccacggccaaggccatcaaaggccccctgaaggatctcaaggcgctgatggtggccagctcgggactcaaacctatcagtttggggcgtgccgatgccgaaagtctgctggcagccatcgatgaccagtttggcggcaccttggaaataaagcttccaggcgcgatcagtgtgacgcagtggcataacgcgtagagaggcgcaagaagaagtcatttgcgcattgagcgactgggttgaatggccaaagcccgagcgggcatgacatcgagccgactgtgtaaagggctgcgcaacggctccccgagtttcgggcaatacccgtgcaccgtgccgctgggttttgctgatggggctgctgggaggcgtctgtaccgatcaaaggcgcttgactggcggcattgacctttgtgccaaagtgtttagccgagcaagacgcgtgaacaaccacgcgtcttgctcaaggggcgatgatccgcaacatcacctgaccggctaagtcgcctatcagccagcggtcatgttctggggaggcctgtgagcatgtcctctgccagtggtgacagcgccttgaacgtgttttcctgctttttcagcgtatgcgtccggagatcccgtcttgcgcaactaaaccggtcgccacctatgcgggagcaactgcgcaatatcactcgaccgctgcgtcggcaggcgcgtgaggacatccttcaaataaggatacggatcatgccattgagccgctccgattggatcaacctcatgatcgccgcggcccgtttgccgctgcgtagtgaacctgcaaagagccagttcttgcgacccagcgcccatggtcggatctggttcttgcaccaattattgtcaatgggtacggccccgtcatcgagatagcgcgacagcgccatccagcgtttgaggctgtaatccaaagctttggcgatagccgagcagtcgtgcacgatctggcgctgggcgatcattcaggcatgcagggcatccatcaccggcacggctttttcttgtcgtattcggtggcgtaagtccggttcaaggtcgcggatttcacgctcgatttcgtacagcaattggatgtagcgcaaggcctgctcagcaagctgactcttgttggtggcgtgcagctcgaagaacttgcgccgtgcatgggccatgcagccgatctcggtgacaccgagttcaaagctggctttatagctgccaaaatcatcgcagaccagcttgcccttccagtcttgcaggaaagttgcgggcgtgttctccggctcggcaggggctgaagtcgtaaacgaccgctgccaagtccgagaactggctggtggcgtaggcccagacataggcgcgatgggttttcttcgcgcccggcgtgagcatctgcaccggcatttcatcggcgtggatcacgtcatgcccaagcaccgtgtcgcgcaaggcatcgaccagcggctgcaactgcacgccacagttgccgacccattgggccaaggttgagcgggcgatggccaaaccggctcgaccgaaaatcgattcctggcggtagagcggcaagtggtcggcaaacttggcgatcatgacatgggccagcagccctgtggtcgggatgcccttgtcgatgacctgagccggaaccggtgcctggatcagggtttcgcactgagcgcagacccatttgccacggatgtgccgttcaacggtgaacacgcccggcgtgtagtcgagtttctcgctgacatcctcgccgatacgctgagagcacagccgcactggcagtggctgctatcgggttcgtggtggatcagagtgcgcggaaactgcggcggcaaggcggtgcgtttaggtttttgccgaacctcagtcgaagcgggagcaagtttcagcgcttcaagttcagcttcgatggctgcaatgtcggtgtcgatcaggtcatcaagaagactggcttgatccggacttaattgctcactgcgcttggcaaacttgaagcgcttgagctgcgcaatctcgtgggtcagcttttcgataaccgtttggtcgcggtggatcttcttgcccattgtctcgactttctgatcgagactctcgacacgctgcatcaactgcgccgccagagcgcgcagttgttcagggtttagttggtcgagattgggcagcgaagtcatgccgccgattttgccagggccggcgaaaaccgacgataggctcataggacaattgcacggcctgggtggtcatggcaggcgttaaacgatggaaatcgcgctgccaggcccgactctttgccatggcaaacccagcaccagggcatgcagttgttcggcgcccaattccatctgagagccgtgtcgagacccggccagaagagtttgccctgatgcagacggcgcgctgccagccagatgcccaacccgtcatgcaccagcactttcatgcgattggcgcggcagttggcaaacagataagcacagtgcggctgcgccgcaccgaacatcgcaaccacccgcgccatcgcggtttcagtgccggcgcgcatgtccatgggctcggtggcgagcccgatggcgtcgatgcggatcatcgcaacaggtctcgcagaaaggtcgcgcaggcagcagcgctttcggtcggtcagttcactttgacagtgccacgcgggtgtgggatttcgaggcagatagtcgatgacgcggcttgcgaatttgctccggctagctgcaagggcagcggaatgaaagcaggttgcagcgccatggctttctgcgtttgcacccgaatccatttatggacgaggttcgcgttgaggctgtggctcagcgaaacgctggcaatcgaggccccgggctgggcgcactcttgaacgacctgggccttgaaggatttggagtaggaacggcgttgtggctgcatgaaatacccgcttaaaaggctagaactggtgtccacttaaattgatctgaccgtattgcagcgtatccgagaggaagagctgtcctatcgccaagttgctgccctgtttgatatccggaaatccgacatcattggcgaatgggagcgcaggtatgatgaaggcggtttggaggtcttgtcccggcagccaggaagcggacttcacaaaaaaatgacaaactccatcccgtccattcagcttgaatcttcggacgatgaagctcgtacgcgtgatgatttgctggccgaattgagccagttgcggatggaaattgcttatttaaaaaagctcgatgccttggttcaagcgaaggaacgagcagcgcagcggaaaaagcgcaaatcgtgattgaactgaggcaggagcactctctggaaggccttctgaaattggctggcctggtccgttgcactttttattatcaacaaaaggtgcagcaatccgttgataaatacgcggagctgaagtccagaatttgctcaattttcgacgagcacaagggccgatatggctatcgccgtatcactgctgccgttcggcgagctggccacctcgtgaaccacaagactgttcagcgcctcatgggcgagcttcagttgaaaagccgtgtgcgcataaagaaataccgggcctacagaggcgaagagggccaggtagcgccgaacctgctgaaacggaagttcgatgccaaacgaccgaaccagaaatgggtaaccgatgtgacggagtttcgggtcggggggcagaagctttatctctcgccgatccttgacctctataacggcgaaataatcgccttcaagaccgcgaggcgcccgctgttcgacatggttggtgcgatgctacggcaagcttttgagaggctgcggccacgcgataaaccgatcttgcattccgaccagggatggcagtaccggatgcctatctaccgccgcgtgctgaacgagcgtgcgataaagccaagcatgtcccgcaaaggaaattgctatgacaatgcggctatggaaagcttttttggcacgttgaaatccgagttcttgaatcgccccggattctctagacaccttgcaagctcattgcgtaacgcttttcaaactctgccggtgacagctgattgttgaagccatgacggcgttttgcgttgtagaacatctcgatgcaatcgaacacatcactacgagcatcttgccgcgaggtgtagatttttcgcttgatccgttcccgtttcagaagctggaaaaagctctcggccacagcgttgtcatgacagttgcctcggcgactcatgctggcaaccaaattgtttgccttcaaaaagctgcgccaatcggagctgctgtactggctgccttggtcggaatgaaccatcacttcttgcttcggtttacgcctccaaaccgccatcaacaacgcgtcaatagccaaatcactggtcatctgcgacttcattgaccagccaacgacctggcgagaaaacagatccaacaccacagccaaatacagccagccttcaaagtgcgaatgtaggtgatgtcggtgacccaaactttgttgggttctacgacatcaaactggcgcttcagcaaattgggtgaggcgaccgctggcttaccgccgtactttccagggcggcgtcgataccctgtctgagagcgcagaccttcaagacgcatcagcctcgctacacgatggcgaccacaatcttcaccgacctcgcgcagatcgtcatggactttgcgatagccataaacgccgccactctccagccatgaatgcttgatcaaacccagcagtcgctggtcgtctttggcgcgtacagattgcggctcggacagccaggcgtaataaccgctgggatggattttaagcgtcagacaaagccgccgaatcgaatagtcgcccgcgcgctgcttgataaaggcgtacttcagccgcactccttggcaaagtacgcggcggccttttttaagatgtctcgctcttcagtgacgcgcttgagttctgctcgcagacgacgcagttcagcgtgctgattatcgtcttgctgtcgttcttcttgaggtttgctgtagcgctttatccaggcatataagctatgcgtcgacacgccaagacgggccgctacatcagcgacaggcagcttcttttcggtcacttgattgaccgcttggattttgaattcttcggggtaacgcgggttgctcatggcacctcctgattggcctcagtttaaggcaaagaggtgtctacgaaacccggggcgatttacagattacttgtctgcaactgatggccaagaagatcgccgtgtctcaaagcacgtctggagacgtgccagactcaggtctcgactcgttgaaccaggatggtgattcagtggagatggcacttgccaggcaattgattgttgcataacaacagggccaccttcgggtaatgccagtcagttaagctgactggcatttttattctgatcggatacttcggtgatttcagccgaatcgcccgaggataaacgcgctcctcacgtcgatgcggcagcacgtagtgcggcgctgaagcatgaagctcggccaaatacttggggatattcccggaacggtcggccgagacgctgttgataaacccgagaatcgcccaagtgcaggcggtgaagctcatttcgcacgggtaaatccccggacagtgacggctcatttccaccatctgatagcgcaacaagttgtagccccacaacacgccccacaactcttgctcgatcatctcgggcgtcttgctgcgcagcgtataactgctgttgagcagcgtctgtttcatctcccgaaacccgagttcgatctcccatcgctggctgtacagatcgacgatttcgtcggatggaaagcatcgcggatcggccatcgacgtcaggatctgacacaccttgcccttgacggttttgctcagcagtcgcgcggtcagccgctccggcaacccgggccattgcttgcgggcctgcggcgaagtgctcagcgaaacaatcgcatcctggcgccacaaacggtggatcacctcgtactgcgagccgttttttcagcggcatcagccagtggcattcgacgcctgcttgctgccattgatgctaacgagtaaaaaccacgatcaaacagggtcagcgagtgatcaggggtggtttcgatcagttgctcggccagtttcatttcgttgctgcggtagccatcaaaagcaccgccgatcaatatgtggctcgtcaattccatctggcagaccatgcgcacctgaggaaaaccggtgtcgccatgctggttgctggcggagtcatagcgcgcccgattttccggcgtgtcgggtgtgcgccagacaacgccatcgacgcccaacaaacgcagaccggcccaagtcggatgaccggccgcttcgtgccaacttttctgggtcaaatcgaagacttgtcgtacagcttcactacccaatctctgacgggcctggactacggcgctgggggccaccaacgggcgctggcccggcaacatgatgttcatgcgactgaccacatcccacgccgacatgcgccggaagaacgccatggaaatcacgcaccagatcatcatttccagcggcaaacgacgcttgcgcagcgtcgtttgccggcttgttcaagcgcttgttcgaccaaagaaggatcgagcaaggcatccaatccttcgatggcgttgggggtagaggcgatgttgtgggtcagttccagtgcccgagcgagacgcataaaaaaatccgataccagtacaggccccggattttgatttcttgcggccaaaggtcaagcgagaaggcttaactgactggcattacccatcgggggcgccttttttctatcgaatgaattagaaacaatgagcacaccacacgaatttatacgcaattaccaccactccaagctaacttgtttctaacaccaaaaatcgggaacaagctatgggagaatacgaagagcaccacgaagaaatcccttcccaggaccctgaagaaattggtcaaatggtaatttactcggctttaaatagcctggtgttcttcgcaagtaacctcgaccttcaggacaccctgaaaaagacttcctgatttggcaaaatccacggacacccgtcaccgagttttccgatgaagcagatacctttgccgacgccgagtacgccggcaagcgcaaacaaactcgcaaggaattgttcctgatcgacatggatcaggtggtgccatggaaggggttgttcaccctgattgagccgcactacccgaagggtgaaggtgctcgtccggcttatccattgatggcgatgctacgcatccacctgatgcagaactggttcggctacagcgatccggcgatggaagaagcgctgtacgagaccacgatcctgcgacagttttctggactgagctggagcgtatccctgacgaaaccaccatcctcaacttccgtcgcttgctggagaaacatgagttggcggcaggcattttgggcgtgatcaatggctaccttggggatcgcggcctgtcattgcgtcagggcaccatcgtcgatgccacgctggtccaggcgcccagttcgactaagaacaaggacggcaagcgcgaccctgaaatgcaccagaccaagaaaggaaaccagtattacttcggcgcgaaagcgcatatcggtgccgacgaagaatcggctctggcgcacagcgtggtggtgaccgccgccaatgtcgcggacatcatcctggtcgacaaactgctgcacggggaggaaaacgtggtgtgtgctgacgctggtgataccggcgtcgagaaacgttctgaacatgaaggtcgtcaggtcatctggcagattgcggcccgccgcagcagctacaagaaatatggaaaacgcagtgccttgtacaaggcgctgcgcaagatcgagaaagccaaggctcaggtgcgggccaaggtcgagcatcccttccgggtgatcaagcaccagtttggttataccaaggtgcggttccgaggcttggtcaaggacaccgcgcagatggtgacgctgttcgcgctatcgaacctgtggatggctcgtcggcatttgctatcgaagcatctgtagtacgcgaaatggttgctacgaggtgctcgcagcggcgaaaaaatatgaaatagacagcagatctgatcgcatcttgacctgctgccgcttttggcatcgagaatgaagaattagccagaaaatattgggctactttcagaccatccttaagcaatattaccactaaactttatgcggtaattctttggaggtctgatttcggactgaaggtggccgggtgttttatctgtgtaattatatttgcgcaaaaatacagttaaataccaccaaagcctttatagagttctaccaatatgagccagacaaaagttttttctgaagcatataatgcttccccgattgtatcttcagttaatatgaggagcggtggcgtagacatttcaatgcctctcgctaaattaagtagcggtcttggttttccggctacctttacgctatgccttctatcaaaagcagggcgtctcggattggatgttcatggtgtaggcaataactggacattcaacgtcccgagagttgatgcggacgccggggttatttacttcagcgatgggacatctgaaaaatacgacccagcaacactgaagcttgtgtatcgaaaactagatgacctcagggtgaagagagacgttggtggagggtatgtaataacccataaaaacggcactgtagaatacatggatgataggggccaaataatcaaattagtatccttgagcggacacttccttaattttatttatgaggaaaatggggctcggcttcgcactctaaaagagattaatgatggcaaagggaataagatatctataagttatcctattgccccctccacagatgctagcaatacaattactattacacaggcggcgggctcaatagtaaaaagagtcaaggttaatttgacaagatttaactcggacttctaccggttggactcaatctcgctgccaaataacgtggcgctgacaactcgcttcgagtatatagaacagaacggatttgtttgggtatcgaaaattacctctccgaatggtcaagtgcaaaaatatacttatagttctattgattgctcaagcactgataccactccagtggtcagcaggctcgagatcatgggtgaacatcaagaagaaacaggtgaaaaaaaaacaatcttatacgaatattcaagcaggaatttcacgggttatacgcctggtgcagtaatgttaccgggtcaagataactgcattttaagggctgatgattatcagtacacggtcaccgaaaaacatagtgatgttcagtatatcaggacatttaaccggtttcacttgttggtgagggaagagtgcaagaagcttatagacgacggagtaagtactactacaaattttgaatatccagttatagagaataagagtatatatgggcaactggcaaattattcactttggacaagatcgaccatgacttataaagggggcgatactgcacctcgaatcgtcaccgaaatacgtgagtatgatgcgcatggaaatatattgatgcgtcgagatatttttggcatggtcgtaataaatgaatattaccctgcgagtggtgatttaaataactgtccgcaggatcctcatgggtttgtcaactatctaaaaagtgcgttgaccaaaccaaatgatgcccccgttaacacggacgttaagtcattacagttgcgttacacctccgtcgcaggattgcgccattctttaccaagcggtggaagcaagaaatccacaatggtgcttgtaaaggaagaaaaggaaaatggtgcaatcgtaaaaacatatgagtacgccgatgcagatttaactccgacggtaaacccgatgtttgtaggtctcccgaaaactgagtctgtcggttcctcctatgtgaaaaactatgactatacattagtgcagtcacgggcaacaatacgcatcgagcagctttcctctgcgctgagaatgagcagttcgaagttagtagatgtgtttacagggcttacgttgcaagagatcgcttttaatggcacgaagaccaactatctgtatgatgaactagatcgcatcattagcaaagccgactttgtagatacggagtgggagcgagcggaaacttattcctacgaaccctataagtatattgacgaagtatatggttataaaaatatagttacagttacagcgcctagcggaatgagagatataagctatatcgactttaataaccgccaaagctacgttcttgaagctcttacaagtactgccactccctattgcacaaggagaattcaatacaatagtgcaggtttggtcgagtgcgataccgagtacgataaagtggagttgccaaacactccttcgcgaaacctcgaaaatagaactcgctacacttacagcatgaggcaggtttcaagaattagttttgcgaatggcaccacgcaaaacgttacgaggaatcatgttctaaatacagagagctctcagcttcaaggggggggcatgtacaccacgacgttcaataaccttggcttgcctgttgaggtaagtgtcaaagtagataatgctaccaccgttttggaatcctatgaatacgacggatttggccggaaaacaaaagaaactttcgcgccggcgaagtgtaatgtttatacctatgatttatttgataggctcatcgcaaaaaccgttaaaggcgagagggaggatgtaacacgctacacctattctcagagtgttaagaatatgtacttgccaactttgttgcattatagtactcgcttggcgggtgttgaagagactatactgcgatcaaccagagaatatgacgggtttggtcgactggttcaacacgacaatcagaaactttcttacgatcagccttattatgataagccatcgaaagtttattatgacggcactgaggatgtgtcttatatttcagaaaaccttgagccgacaacgttgcttgtcgatgcagtgaatatagttggcgatggcgctgccacagttaggcacaggtactcaaaagctaccggatggcaattaaactcttcctccagtaaatgcaatattagttatacgtataacgaaagaggacagcccaaaacagtttttggcgtacatactcatggtgatacgcgagccatcacgcgtgtttttaaaaattattctgctagtgggaagcggttgacgagctccatcaatcacttgggggtgaatgaaaggtgcgagtactcctctactggtgagatgataagcaaggagtacgaagggattgcaacaatttccattggatacaatgccgatggaaaaatctcacgcattgatgtgctgtcctaccggtttgcttacagtggtccagcaaaaaagcacttacttgcgactattacattttcctacaataaaattggtctggagtcgcaacgagacattaagctttctaccattggcgctcaaaccaccatgctggacgttgtaaacacatatgacaactactcaagacttacctctcgacacgttacgaaaggaccaagcagcgttgtcacgactcaggcatatacttaccaactgccgcatggacaattaagcagctccacgttaaagcgcaataatgttgtagactcggtcatagactatcaatacgtgggtggtcagcgctttaagtcaatagaggagactggtaaaccttgtgcggactatagttaccaaggcgaccgtgtttctcgcattcaagagggaaatattagcaaagtcttcacagcagatttcatggggaatattactctcgtggacggacgttctgttcgctacagtgccgttaatcaggttgctcatgttgacaaaggcggtaccacatacgattatttctatgagccatcagggcgtttaagtcagatcgttaatggggatgatgctgttatttatctttatgatgatgatgaattgaccgctgaaattagtggtcctgtaaaaaccttgtacctaagagttggagatataaccattggtcgttatatctcgcatggtaaagatcaaaaactagaattgtacggtactgacacaatgggaaccgtacgttgcgtcaagacgtttgctccgggcaacgtaggggaaaacgaaatctccagcgcctactacgattattcggattatggtgttcgcacttctaatgctacggatgacgtaagcgaacgccgcaaacttatcgatcgcaatacgctagggtttaatggttgtttatttgatgatgtttctgccacctacattctcggtcacgggtatcgcccatatagtccaactactagaacatttatttgcagagacagcttaagtcctttcggtgttgctggcgtcaatcagtatcagtactgtaaccttgatcccatcaacaacatagatccaagcgggcatctcagttattccgctcaatgggggctcggcctcggtatcgcaggtttgcttttatccgtcgtgcctgttgtaggcgttcttgctggtggaacacttttgacattggctggaggcttgggcgttgcaggaggagtactgggcgcgacttcgtcggctttgggcattgcttcttctttaaccgagaataacgaagagctttcaaataacttgggatacgcctcgcttgcctttgggattgcgtcgttgggagcgggtattgcccgatccgcggtaaattttcacgcgcgggcaattcaaggcgctgcgggagcacaatatagcgcccgaactttgggaggtaccgcctatggtccaattgagtattatcagaaaacctccaggattgttgccgaaggagcgccatttgttacccaaggggcttcggggtggttagattcgggggggcagcttgcaaccaggctgcgtccgatcttgcagggcaacggcccggtgacattggcaagttgtttttcttctgtgggtggaaagtatggatctcaggcgcagcgattggccaatgcgcttggtcgtcctgtcacgggctttagcgggtatactcatccaggcacgagcttaaagggtgcaacacagttctttccacaaacaggttttacagctgcgagaactaacgcgctaaataatacaggggccttattcatgaaggcgttcctatatggaatacgttgaaaaccttgaatagacaggtttacaatgtgaaagggcgcaagttgaaatcttgcgcctccttgcaactgcttgctgccggctaacagttcttaaagaggtagatgtgatggagtgtgggggggctaaatatactttcaggacaccaaatttgtacacgtgaaatttaagcaatgtacaaaaagtaatatcgcaaacacctgatggcgcaagccaatgagaccctcgtgctaaaactttcgccagcttatcgtagcgggtgccgattctccggctctctttcagccagccaaacatccgctcgatgatgttccgttgccggtatctcggacgatcaaatagccggagtagtcctagcttgggtttgcgcttcatggtgcgctgcgcaatcaccggctgcacgcggtagcggtcgcagtactggcgcagatgctcggcatcgtaacctttgtctgccagtaaccaatggcagcgcttacgaggccgtcccgattttaaatacgcacttgatccaagagcggctgagcatgtgcaatatcgctggcctgccctggtgacagcatgaagcgaagaggtatcccattgtaagcgctccatgaaccccacattttaaagatgggatctacggctatcttgaaatttgcagcgtgcagttccacggcagcaaggcctcggagtcttctacgttcgaggcttgtggcaggcgctcaagtgcgtggcacagccacgcatagggctcttggccgttggctttagccgtctcgaccaaactgtaaagttgagcgctggccgtcgcgcctttgggcgtgtcgctgaacagccaattcttgcgcccgatcacgaagggccggatcgcccgctcggcggcgttgttgtcgatcggcaagtaaccggcttcggtgtagcgcaccaatttggtccaattgctggccaggtagctgatggctttgcccagtgcattttgcgccgtgactggtgcctgggttttctccagccaggtgtgcaactgcgccaacaccggcaggctgtggtgctgtcgactttcgtggtgcggttcatcgccgacttcttttaaatctcgctcgataccgtacagcttgttgatcaggttcagggcgatatccgcgcgcccggtcttgcctttgggctgcactttttgcgctgcgacgaacttgcgtcgcgcatgtgcccaacagcccatacgctcgataccaggctgtacacctagggacaccctggccaacatcgccgccgtaccgtaagcggtgtcgccaatgaggcgttccggcttgatgtcgaactgcgcttcgactcgttcgatcatcgtcttggtgctctcgacttctgcagttcgatgagccggtgtgggttccacattgtttgaaatgcgttacgacagcgagcttggagagtgtctagaaaacccgaggcgattcaaaggcccacgaaagtgaggattttcggggttttttttgcctgcagaaaagtgtggatgcggggctggacggtgttcaaggtacaacaggggcctctaagatctacgtacttgtgatggtcctaccgcgcttctgtcggcccataccgcccatggcccttcaagatcttgtggcttcagcattctccccctcatgaagggagcacaggtcactacccatccatgtcgtctcacatgcacgaacgcgttgcgacgatgcgcgcctgcaccagacccgatgccattcggccactcaaaggtcgcgattggacaacatccggttcgatacgaaaaagcagaatacatgccacatgcacctaccaattctggtagttgccggtgctcaagaatgcccgaatgatgatctggccgctcactcgtccttatcaatgactcaaacaacgctcgccggaacgcgggtgacaaggtcgagcactccggcaagacgctcacttcatgtcacaggacgttacgggagacagagtcatgttggatatcggaagctcggataccttgaagtacgatttcggcggaaggtcatacacgatccagatttacaaggacaatcaggacgcgaaaaagtattacatcgttccgcagccgcaattcgcgaccgccgtgagcggcctgccggaattctcgctgcgacagttcaagaatggcaaaggcgtttccggacagtgcaatttccagaccgtgctgcaaacgccgccgggggccatcgaggccgtgcagaagaagttcggcaacgacatccggatcggcggctgggactggaccctcggcatgacctggttcaactaccagtatcccgacgacaagggccagatgcgtagctattcggcagtggcctggccttctctggcgccgacgaccggcggcgccgggcaggcgagtgctcgcgcaacattctcgatctccctgccggaccaggccgcggtcactgcgtttatcaacgcgttcagcaattcgggggggggggcggcacatacgaggtccagtatcagatgcatgtgccgggatcgttgccgggtgtgaccgtcacggttgggttcgactcgagcgtcgcttatcagtacgaacagaccatccacgtcgacaaaaacgtctggggttcggaaaccagccgcaccgtcgaagtcaatcagtacctgagccagtcgcaggccggcacgatcgattatatctggggcaagatcgatccgatgtcggcgcaggggcaggcgatcacgaactgggcgcaacagacgttgcagaatgccgtcacccagtcggtcaattcgaccatcgcgatgatgcaggcgaataatccgtcaggaaacgactacacgttcagcatgacccaggtgagttcgttctcgtacacctattcgcagaacacagtggtcgactggattgcgcagtcgtcgaccctgctgcccgctttccccaagaatgtgtgggagcaactctacaaggaggtcgactacagcccgctctcggtggtgttccagttcactaacgtcgatccgacccgctacgggatcgcgtcggtgcaggttctggtgcaatctccgtcgggcaacgactccacgaccctgaccaaggatgcgaccagttggcccttcacgcgccccgcggtcaccaatccggatggctcgcccaacctgcactactcgtacaaatacatcgtcaactacagcaacggtacgtcgtatcagtcgcagacgatccagcgtgacgccgcgctcatcggcgaggcgagcgtggagttcgatgccggctcgctcgctgcgctggccgtgacgttcgagacgatgggcatccagtttggggcctccaaggaactggtgcagcatgtgcaagtcgacttcgtattcgtcaacaccaacgtggcccccggccagccagcagagaccaagacgctgacccatctgttctatgcgaacgacgaaaagtgggacgtagcgttcctgactgcgcttccctatacgacgacctacacctactcggtgttctacgtcatgggagacggttcgcgcgtgaccctcgcacccagcctgccgaccaaccagaactccgtgccgatcggatccccgctggccctgcaacaagtcatcctgtatccggtatgggcgacggacatggaaaacgtctatgtgtccgcgtactacgtcgatccggacaatagcgtgtcggtgcagggcaatgtctggcaggtcgacaagaaaggcgatcctatcgacccgtggaaattcctcgcgccgaacaacaagaacgcctactgcgacgtgacagtgcaatacctatacgacggcgcgatcatcgggtacccgacgccgtggtacgtgccgcagcggcaaccgatcaacgtcaccgcgaagcagaccccgttcatggtgaccatcgatccgtcgctgattcagtggaatctgtacgacatggtcaagatcgatgtctacctgctgaatgcggccgggcaaccggtcaagcaacacccgttccagttcctgaagggaacgggcagtcagtactactcgttcatgctcgacggacaggagcccagcctgacctggtactactcgggtgcctactatccgaaggacgcatcgccagtcgtcatccagcagacgaagatgacgtcggcgctgctggtgctgccgaggacgtggagcgacaggcaggtgcaggccaacgagcggccctacctcgttcctcaagagcatgcgcacgcgatcgaggcggcccaccgccgtctgatcacgggcgtcaacctggccaacgagaaagagattgcgagtgtgaaataacgtgcgccaccgccccgcttgcaccgggcggactgcaatgccgcgggggggctgtcgccccccgcattcctgcacgcactcataggttcggagccaccatggcgaacatcctctatcgcatcgtcggtcacgggttggacggggataccccgacgctcagcttgatcgtgctgaacctcgtctacctcgacacggagcacaattactgcgcgaaccactggtgtgcactcaccgctgagcatccgcaagacacctggcagttcgaccccggccccgccaccgatggcgtggtcctgtatgacggccagcagttcggccccaccggcgaagtcacgccgattccactcacagtggccgacggcacgacgatcgaggtcggtgctggcgttcccgccaccatcgccgtcaccgtcacaccgctgctgatcgactggagccgggtcgtgcgcgtcgacgcggagctcgccggccacccgctgaccttcaccgctgccagcgtcaccgcccgctggctgtcgctgccggccgcgggttacccatggacggcgacctacacgctgaacgacgactcgacctgggagcagtcaggagccggttcgccgccgctgctggtgctgccggcgctgccgctcgtcacgccggtcacgttctcacccgtcgcggactacttcgaaacgctgccgattgaatcgatcgcgctgagcgtgacaaacccgggcgggtcacctggccatagcatcttcaacccgggccacacgcagccatggtcgactggcatcttccagacagcgatttccccagtcgcctggcggctcgactaccgctatcgctacgtcgtcacgttcaagccggaggcgggactccagccgttcgattcgggcgagatcgacgggctgggcgcgacatcggtcacgctcgacgaggtgggcattcgcgagttcgtcctcgacggccagatgcccagccttatcaagagcgtcagcgtccactatgaattcggcgggaagagcgagaagcgcacgctgccggtgcgcctcgtcgcgcgcagcaactatacgccgggctcgttctcgtactggctccaatacacgatcgccggcaagacgccggactcgaccggccaggagaccggcagcgttatccagcccggtgcgcagcccgccctcgcgttcgtcagggccgtgtccccgttacaggagaaatcggtcagcttgactgcgcacaagttaggcgtgggggatcaggtgcagcttgcgctcagcacgagcgaatcgggcaacctgggcatcccgtcatggcaatgggcgatccagagcaccggtccggggaatgtcatactcaatcgtacccatccgtccattacgtacaggtacctggtggtcgatccggattgcgccgcgaccagcttcaccggcacgctgcaggtcgacgaggagctgacgccattcaacgtcccgacggccgacacaagcgtggaaattacgtcgcatacgctgcccgcgtcggtcacgctcgatccgtcgcggattgattggagcgtgaacgagcacgtgaaggtgacggtaacgttcaccagcccgccaagcgacgggcaagacttcacgttcacccgcgaaaacggctacgagtatgcgaacagcacgtccgtcgacggcgtgacgccgatctacgattaccttgcccgctattacctggcggacgggacgacgcgcatcgagtccgcagataatcagacgagcatgctgctggttttgcccccgcgcggtaccgggcaggggtagcgcgatggcctggcccccggcactcgaacgcgcgctgcgcatcgcccggcactttcacggcgatgacgccaagcaggctcgcacgcaactgcaacgcctgctcgacgatcacgtccgtgcagccgacggcttcacggggagcctgctgaccatgagcggcttcccggtcgagatcgcattctccaccgccgacgatgcgttgcgctatacggtcgacctggcgctgcccggcagcgatccgcacggccgagtcgatgctgcgctcgggcaactcgccgcgctcggcgccgcgccggcgcccgcgtccaccgtcgacgcggtgcgccggctccaggccggtcagccgctgcgcttcggcgcctatgtcggtggacgacatcgcgcggggcagtgtcgcgccaagctctacgtcgaggtgccgaaggacgcggcggccgatgccgacgcctttgccgccgaggtgatcggcaggcccaagtcgctcccggacaagcgccagcacatcgagctgatcggcgtggaccccgactcgcagcgcacggagttttactcgcgaatcgcaggcatgattgcgccggacctggtcgcgctgctcgcgcgggtgaatctcgcctcgcgctaccgcgagctcgtcgagctgttgggcgaatgctgcgtcgtgccgatctggcgcgagcttccgggcgatctgtacggcttcagctattcggtctgtgcgcgtggcgagccgactgcattcacgctctacacccacgcgcgcgcgctgttcggcggcgatggacggacccgtgcgcgtatcctggagcttggtcggcgccacggatgggacctgcgcttctacgaacaattgacggaaccgctcgccgcgctcgacgacccgacgacccatcacacgatgtttggcatcaccgtgcacggtgacgccgggctcggcgtcacctttggcgtcgcgccgccgctggagccggcatgagcggtctccatccgaccgcccctggagccgcgctggacgcgttgctcgccgcgcaatcgcccagcggcgcgttcgggtccgtcgtcgctctgccgacaggcccggtcgccgacgagaacggtttcgtgaccgcgctggtcctgcatgagctctcggcatggcccgcgacaccggcgctgaccgcggcacgcctgcgcgcgctcgacttcctggcgtgctgcgagcggacggaccggcgcggcgcgttctcgttctatccgcccgaccgccagccggagtggatgcccattgcgctgttgccggacgccgacgacaccgcactcttcaccctcgcgctggtcgacggcggccgctggccggcgcagcggttgacgcacgccgtgcgcggggtgctcgaggcgtttcgcctgaggtgggtcgcagccgatgcaaggccctggtatcgcgaaggcgtctacctgacctggctggatgaattggtctacccgaacatcgtcgatctatgcgtgaacatcaacgttgctgcattgctcaagcgcgaggggcctgagcatgcctgcgcactggccgcgatcgtcgacatggtggatgccggactcacctgggcgggcacatcgccgcagcgcgcattcctgctgacgccttactatccgcatccggccgaactcggtcatgcgctcgatcgcgcgatccgcctgggcgtgaccgagttgctgccgtgccgggacaaattgcgggacctcggctggtcgtacgcggccgatcctgccggctggccgctcgataccccggtctgcagctcggacgatgggcgaatcgtctggcgtgcgcccgtgctccagcaagcacggcaactctgccgccgtccgtcaccaacgacggttgcgtttttctagcagtatttaaaatccgaaaggcccacgaaagtgaggattttcgggttttttttttttgcgaaaaagtgtgggccgggtctggaggcagtgtggagctaccaggctatagctgtgcagctgtctgggtcgaaccctggattcgagccggtgtgatggcaggagcgagcctggaccatggtcggcacgaatcgatactgcgctggaccaagtcctcaatctcgtcgctaaagatcgcccgtcgtgagggctggcggtgggcgatggatcgacagctcgggcgccctacagaggagtcaggacattcatcacggtgtccagggccacgcgggtgtcatccagttgcaccagtgaggcatgccgggcgccgagggcgtcacggttcttgatggcggtcaggatcgccttgtgccggggtaggctgagacgctggatatcggggcggcggttagtgatgctgatggactcgcgcagcggcagcgacagcatgttgcacatgtaggcgagcaagtcgttgcgggtggcgtcggcgatcgcccgatgaaaatccaggtcggcctgcaagagctcctcgtgggtcttggccgtctccatggactggtaggctttctcgatcaccgcgatatccgggtcggtcgcggtggtggcggccatggcggcgatttccggctcgaggatgcggcgcacgcccgccagggtgttgaagaactcgctgtgaggcgtcgactgcatcaaccaggacagcacgtccgggtccagcaagtgccatttcgcccgtggccgtaccaccgcgccgacccgtggcttggagtacaccagccccttggcgctgagcacccgggtagcttcgcgcagcaccgagcggctgacctggtattcctcacacagcgttgcctccaagggcaatctatcttccggcttgaagcgtccggagacgatgtgcatgcccagatcctgaacgatccgggcatgcatgctcttgcggggtttggaaggctggtgatccataacagggaggctgctctgaagaaattggctgcatcatagcatcgctcccgtatctatcaggcgctcctgcatgcctgaaccggtgggcgacgggcccgcatcagccccctcagtgggaatgccgcgggatctcggcgccccggcaacccaccaggaaatcgaagtcgcagccctggtccgcctgcagcacgtggtcgatatacagctggcgataaccgccgacgatcagtgacggcggcgtttgcaggtcgctcatgcgcgccgtcagttcggcctcagggatgtccaggtgcaggcgtccgctggcacagtccagctcgatccagtcgccttccttcaccgcggccagggggccgccggccgccgcttccggcgccacgtgcaggaccacggtgccatacgcggtgccgctcatgcgcgcgtcggaaatccgcaccatgtcggtcacgccctgggccagcagcttggccggcaggcccatgttgccgacctccgccatgccggggtagcccttggggccgcagttcttcatcaccaggatcgagtcggcgtcgacctccagctccgggtcgttgatccgcgccttgtacatgtcgaagttctcgaacaccaccgcgcggccacgatgctgcatcagttcggcgctggccgcggagggcttgagcaccgcgccgaggggcgccaggttgccacgcagcacgcagatgccgccgtcggcgcggatcgggttgtcgagacggcggatcacttcgtcctggccgtagatcggcgcgtccttggtattttcgccaatagacttgccgttgaccgtcaacgcatccgggtgaggaatcagactggcctcgccgagacggcgcaacaccgccggcaggccgccggcatagtagaactcttccatcaaaaagcgtccggacggttgcaggtcgacgatggtcggcgtgccgcgaccgatgcgggtccagtcatccaggtcgagttcgacgccgatgcgtccggcgatggctttcaggtgaatcaccgcgttggtcgatccgccgatggcagcgttgacgcggatggcgttttcgaacgcctctttggtgaggatcttcgacagccgcaagtcttcgcgaaccatctccaccgcacgcatgccggacatatgcgccagcacataacggcgtgcatcgaccgccggaatcgccgcgttatggggcagggaggtgcccagggcctcggccatgcaggccatggtcgaggcggtgcccatggtgttgcaggtgcccgccgagcgcgacatgccgccttcggccgcaaggaagtcatcgagggtgatggtgccggccttgacctgttcgctgagctgccacaccacggtccccgaacctatgtcctggcccttgtgcttgccattgagcatcggcccgccggtgacgacgatggccggcacgtcgcaactggccgcgcccatcagcagcgccggggtggtcttgtcgcagccggtcagcagcaccacgccatcgatcgggttgccgcggatggcctcctcgacatccatgctggccaggttgcgggtgagcatggcggtcgggcgcaggttcgactcgccgttggagaacaccgggaactccaccggaaagccgccggcctcgatcaccccacgcttcacatgctcggcaatctggcggaagtgcgcgttgcacggggtcagctccgaccaggtgttgcagatcccgatgatgggcttgccatggaactggtggtcggcgatgccctgattcttcatccagctgcggtacatgaaaccgttcttgtcggcggtgccgaaccagtgggcggagcgcaggttgggtttcttatcagacatggtcaggctctcttattgtaagactatattgttctggtctggccataacataagcgcaaaatcgtgggtttggaagtattgttggctaaatagtaatactatatagtcgtttgcaactgaggtatggccctggcggttttccgcgagaggcgtcccccgagcttctataaaaacaacaatcggagaccgagctcatgagccaggaattgcggcttattcggcgcatcacgctgaaactgattcccttcctgatcctgctgtacctgatcgcctacgtggaccgttccgccgtcggcttcgccaagttgcacatgggcgccgatatcggcatcggcgacgcggcctatgggttgggtgccgggctgttcttcatcggctacttcctcctggaaatccccagcaacctgatgctcgaccgcttcggcgcacggcgctggttcgcgcggatcatgatcacctggggcgccatcaccatcggcatggcgtttgtccagggcccctacagcttctatctgatgcgctttctgctcggcgcggcggaagccgggttcttccccggtgttctctactacatcacccaatggttcccggtgcgccatcgtggcaagatcctcgggctgttcatcctgtcccaacccatcgcgatgatgatcaccggcccggtgtccggcggcctgctcggcatggacggcatcctcggcctgctcggctggcagtggctgttcatcgtcatcggcacgccggcgatcctgctgacctggccggtgctgcgctaccttcccgacggtccgcaacaggtcaaatggatggacccggccgagaaggcctggctcaccggcgagctgcacaaggacttgcaggcatacggccagacccgccacggcaatccgctgcacgccctcaaggacacgcgggtgctgctgctggcgctgttctatctgccggtgaccttgagcatctatggcctgggcctgtggctgccgacgttgatcaagcagttcggcggcagcgacctgaccaccggcttcgtctcgtcggtgccgtatttcttcgggatcatcggcttgctggtggtgccgcgcagttccgaccgtctcaacgatcgctacggccacctggcggtgctctatgtgctgggggcgatcggcctgttcctcagtgcctggctgtcggcgccgctgctgcaactggcggccttgtgcctggtggccttcgccctgttttcctgcaccgcggtgttctggaccttgcccgggcgtttttttgccggcgccagcgcggcggcggggatcgccctgatcaactcggtgggtaacctgggcggctacatcggtccgttcgtgatcggtgcgctcaagcagtacaccggcagcctggcgtcggggttgtacttcctgtccggcgtgatgctgttcggcttgctgctgacgggcatggtctatcggttgctggagcgcaggcacgtgctgccggtcgagcagttcgccgccagtgcccgcggcgccactcgtacttaatggcctagaggagaaagttcatgcgtttagtgcagttcgaattgaataacggcgagcgccgggtcggtgtggtcgaggacgctctggtccgtgaagtgcaatcggtgaacacggtgcgcgagctggcgctggccgccatcgaggccggtgtcggcctgcgcgagcaggtgcagagcctcggcctgggcatcagccacgactacgccgagctgctggcgagcctgagggtcctgccgccattggatcacccggacccggcgcacatgctggtcagcggcaccgggctgactcacctgggcagcgccgcggcgcgggacaagatgcaccagcagggcgctgacgacacggcgctgaccgacaccatgcgcatcttcaagtggggcgtggaaggcggcaagcccgctgccggtcaggccggcgtgcaaccggaatggttctacaagggcgacggcagcatcgtcgtgcgcccgggccaggccttcagcctgccggcctttgccgaagacgccggcgaagagccggaaatcggcggcctgtatgtcatcggccatgacggcaagccttatcgcctggggttcgcggtgggcaacgagttctccgatcacgtgatggaacgcaagaactatctctacctggcccattccaaattgcgcagttgcagctatggtcctgaactgcgggtcggcgagctgccccggcacctggcgggcaccagtcgcatcctgcgcaatggccaggtgctgtggcagaacgagtttctcagtggcgaagccaatatgtgccacagcctggagaacctcgagtatcaccatttcaaatacagccagttcctgcggccgggggatgtgcacatccacttcttcggcaccgcgaccctgtcgttcgccgacggaatccgcacgcagccgggggacgtattcgaaatcagccaggcggagttcggcgcccccttgatcaacggtatcgccggcgtcgacgcggtactggcacccggttgcgtcggcgctctttaagccgccgctcgttgagcagacgccctttgaacgaacaacaggagacaggcatgccccaggttcttggtcacaactacatcggcggccagcgcagcgccgccggcaccgtcattcttcacagcatcgatgccagcaccggcgaagccttgccccacgggttctaccaggccacggcggaggaagtcgacgccgccgccaacgctgccgcggcggcctacccggcctaccgcgccctgagtgcgcagcggcgcgcgcaattcctggaggcggtggcggatgagctggacgcgctggacgatgagttcatcgccctggtctgccgggaaaccgcgttgcccaccgcgcggatccagggcgagcgcaaacgcaccagtggccagatgcggctgttcgccgaggtgctgcggcgcggcgatttctacggcgcgcgtatcgatcgggcgctgcccgagcgccagccgctgccgcgtccggacctgcgccagtaccgcatcggcctggggccggtggcggtgtttggcgcgagcaactttcccctggcgttttccaccgccggcggcgacaccgccgcggcgctggcagccggttgccccgtggtgttcaaggcccacagcgggcacatggcgaccgccgagcgggtcgccgatgcgatcgtccgggcggcccaggccagcgggatgcccgccggcgtgttcaacatgatctttggcggcggggtcggcgaagcgctggtcaagcatccggcgatccaggcggtcggtttcaccggctcgctcaagggcggccgggcgctgtgcgacatggcggcggcacgcccgcagccgatcccggtgttcgccgagatgtcgagcatcaacccggtgatcgtgttgccccaggcgctgcaagcgcgggcgcaaatgatcgcccgcgacctgaccgcctcggtggtgcagggctgcggccagttctgtaccaaccctggcctggtgatcggcatccgctcgccgcagttcgccgccttcaccgagcaggtggcccggctgatcggcgatcaaccggcacagaccatgctcaacgccggcaccctgggcagctacgacaaaggtttgcaaaagctgctggcgcacccgggcatcgagcacctggccggcgctccgcaagccggcaaccaggcgcggccacagctgttcaaggcggatgcccgcctgctggtcgagggcgatgaagtgctgcaggaagaagtgttcggcccgaccaccgtgttcgtcgaagtggctgatcaggcacagctcaatgccgccttgcacggcctgcgtgggcaactgacggcgaccctcattggcgagccggcggattttgtgcagtttggcgagttgacggcgttgctggaacagaaggttggccgcatcctgctcaacggttacccgaccggtgtcgaggtcagtgacgcgatggtgcacggcgggccttatccggccacctccgatgcccgtggcacgtcggtggggaccctggccatcgagcgtttcctgcgtccggtgtgtttccagaactaccccgataacctgctgccggatgtgttgaagaatgccaacccattgcgcatccagcgcctggtggatggacggccctcacgcgacagcctgtaacacgaacccattagtgcctacctgaaaacaaacacaatgcaggaggtttcatgtcgtggaccgcagtgagcacacaccgtgcgcggctgggcgaaggcccgttctgggacgcgcccggccaggccctgtattgggtcgatatcgccggccggcaggccttgtgcctgcggggcgggcagctgcgggcctggcacctgccggaaccggtgtcggccttcatcccctgtgagcgcggcgatgcgctggtgaccttgagcagtggcgtataccgcctcgacctggactccgcgcccgccgcgccgcgcctgagcctgctctgcgtggccgatccgcaaccgggcaaccgggccaacgaggcacgctgcgatgcccagggccggctctggctgggcaccatgcagaacaatatcggcgagcgcggcgaagacctgccggtgcggcggcgtttcggtggcctgttccgcatcgatgcccaggcgcgggtcacgcctctgctaaagggcctggggattcccaacaccttgctgtggagcgaggacgccagccgcctgtatttcgccgacagcctggacggcacgctgtatcagtacccgattgccagcgatggccggctgggccccgcgcaggcgtggttcgggccacacccgcgcggcgtcccggacggttcggcgatggacgccgagggttatatctggaatgcccgctgggacggcggctgcctgctcaggctggcgcccgacggcgaggtcgaccgggtgctcgaactgccggtcagccgccccaccagttgcgtgttcggcggcgcggacctcaagaccctgtacatcaccagcgcggccagcccgctcgaccatcccctggacggcgcggtgctggccgtgcgggtcgatacccccgggaatctctgtcatcgctttgccggataacgttcaggctttacctgtgtgcaacgaactctgaaaaacaacaacaaggagtcacctttatgaagcgtcgtcgtgggattcgttacctgtgttgtgccgccctggccatgtcggccgccagcctgagctgcctgtcgcttgccgccgagccggtgaagatcggctttctggtcaagcaggcggaggaaccctggttccagaccgaatgggcctttgccgaaaaggccggcaaggacaagggtttcaccgtgatcaagatcgccgtgccggacggcgagaaaaccctgtcggcgatcgacagcctcgccgccaacggcgccaagggtttcgtgatctgcccgccggacgtgtccctcggcccggcgatcatggccaaggccaagctcaacgacttgaaagtgattgccgtcgacgaccgttttgtcgatgccaagggccagttcatggaagacgtgccctacctgggcatggccgcgttcgaggtaggacagaagcagggcgccgccatggccggcgaagcgaagaagcgcggctgggactggaaggacacctacgcggtgatcaccacctacaacgaactcgacaccggtaaaaaacgcaccgacggctcggtcaagtcgcttgaggaagccggcctgcccaaggaccacatcctcttcgcgccactcaagaccctcgacgtgccgggcagcatggacgccaccaactcggcgctggtcaagctgcccagcggggcgaagaacctgatcatcggcgggatgaacgacaacagcgtgctgggcggcgtgcgcgccaccgaaagcgccgggttcgccgcggccaatgtgatcggcatcggcatcaatggcaccgacgccatcggcgaattgaagaaacccgatagcggcttcttcggctcgatgctgcccagcccgcacatggagggctacaacaccgcgagcatgatgttcgagtgggtcaccaccggcaaggaaccgcccaagtacaccgcgatggacgacgtgacactgatcacccgggacaacttcaagcaagaactggaaaagatcggcctgtggaactgaaggccgtcgactttccccggcagcccgttcgcacgggccgcctgacttgatgaggtggttatgcacgcgcaactgaataaacgacaacacagtgccggcgccagtttgtgtttcaacggcatcggcaagaccttccccggggtcaaggcgctggacggcatcagtttcaccgcccagccggggcaggtgcatgccctgatgggcgagaacggcgcaggcaagtcgaccttgctgaagatccttggcggcgcctacacgcccagcagcggcagtgtgcagatcggcgagcggaccatgacgttcaaatgcgcggccgacagcattgcctgcggggtggcggtgatccaccaggagctgcatctggtgcccgccatgagcgtggccgagaacctgttcctcggccatctgccggccagcctcggggtgatcgaccgccgtgcgctgcgccagcatgcactggaatgcctcaaggggctggccgatgaaatcgatcccgaccagaaagtcggccgcctgtccctgggccagcgccaactggtggaaatcgccaaggcgttgtcccgtggtgcccacgtgattgccttcgacgaacccaccagcagcctgtcggcccgggaaatcgagcgcttgatggcgatcatcgggcgcctgcgggacgaaggcaaagtggtgctgtacgtatcccatcgcatggaggaggtgttccgtatctgcgatgcggtgacggtgttcaaggacggccgctacgtgcgcaccttcgaggacatgagcgcactgacccacgaccagctggttacctgcatggtcggtcgcgatatccaggacatctacgattaccgcccgcggccccgcggcgcggtggcgctcaaggttgatggcctgctggggccgggcctgcgtgcgccggtgagtttccaggcgcaccagggcgaggtgctcggcctgttcggcctggtcggtgcggggcgtactgaactgttgcgcctgctcggcggcctcgagcgggccagcgccggaagcctggcgctgtgtggcgaggcattgcgcctgcgctcgccgcgcgatgccatcgccgccggggtgctgctgtgtcccgaggaccgcaagaaggaaggcatcattccgctttccagcgtggccgagaacatcaacatcagcgcgcgcggcgcccattcgacctttggctggctgttgcgcggcggctgggagaagggcaacgccgacaaacagatcaaggcgttgaaggtcaagacgcccaacgcggcgcagaaaatcgtctacctgtccggcggcaatcagcagaaggccatcctcggccgctggctgtcgatgccgatgaaagtcctgctgctcgacgaacccacgcgcggcatcgatatcggcgccaaggccgagatctatcagatcatccatgacctggcggccaggggcatcgcggtgatcgtggtgtccagcgacctgatggaagtgatgggtatctccgaccgcatcctggtgctctgcgaaggcgcgttgcgcggcgagaagagccgtgaacaggccaatgaatccaacctgctgcaactggctttgccgcgccaacgcgccgacggcctggagaactgaagaggtgaacatgacaactcaagacaacgcgctgccgacggcgcgcaaacccctggacctgcgtggcctgctcgataactgggcgatgctgttggcggcggtggggatcttcgtgctctgcaccctgctcatcgacaacttcctctcgccgctgaacatgcgcggcctgggcctggccatttccaccaccggcatcgccgcctgcaccatgctctattgcctggcgtccgggcatttcgacctgtcggtggggtcggtgatcgcctgtgccggggtcgtcgcggccgtggtgatgcgcgacaccgacagcatgctccttggcgtgggcgccgcgctgctgatggggctgctggtcgggctgatcaacggcatcgtgatcgccaagctgcgggtcaacgcactgatcaccactttggcgaccatgcaaatcgtccggggcctggcctatatcttcgccaacggcaaggcggtcggtgtatcccaggagcaattcttcgttttcggcaatggccagttgttcggggtgccagtgccgatcctgatcaccatcggctgcttcctgtttttcggctggctgctcaactacaccacctacgggcgcaacaccatggccatcggcggcaaccaggaagccgcgctgctggccggggtcaatgtcgaccggaccaagatcgtgatcttcgccgtgcacggggtgatcggcgcgctggccggggtgatcctggcgtcgcgcatgacctccggccagccgatgatcggccagggcttcgagctgacggtgatttccgcctgcgtgctcggcggggtgtcgttgagcggtgggatcggcatgatccgccacgtgattgccggggtgctgatcctggcgatcatcgaaaacgcgatgaacctgaaaaacatcgacaccttctaccagtacgtgatccgcggttcgatcctgctgctggcggtggtcatcgaccgtatgaaacaacgctgattacgggggctgcggcaagggatgccggcggcgcgatacgcgtcgccggccggcccgtccccttgccgaatctgtaggcaagaggcgggcggcactggcgtttcagtcggcggagaacttcagcacggtgtcctggctgtagacctggccggggttgagccgggtgctggggaagtccggctggttgggcgagtcggggaagtgctgggtttccagggtaaacgcgccccagtggttgtaggtcttgtccgccttgcccttgagcgtgccgtcgagaaaattgctggtatagaactgcaccccgggttcgctggtgtagagctgcaagcggcgaccggattgcgggtcgcgcacttcggcggcgagctggccgacatcgcccttggcgtcgagcacccagttgaagtcgaagccgccctgtttcggctcggcgaacttgagctgcggatgatcgtccttgatgcgctggccgatggcggtcggttgccggaagtccatcggcgtgccagcgaccggggccagttcgccggtcgggatcagcctggcgttgaccggcgtgtagtggctggcgtgcagggtggcgagctgggcgagcacatcgccgttgccggcgccggcgaggttgaagtagctgtggttggtgaggttcagcaccgtgggtttgtcggtggaggcgctgtattcgatgcgcagctcgttgttgtcgttgaggctgtaggtgacctcgacttgcaggttgccggggaagcccatttcgccgtctttggacaggtagctcaaggtcaccccgacggcgtccttgcgcttgatcggccgggctttccagacgcgcttgtcgaagccctgggcgccgccatgcagcgagttcgggccgtcgttgagcggcacctggtaacgctggccgtccagctcgaacgcaccgccagccaggcgattgccgtagcggccgatggtggcgccgaagaacgcggtaccgcgctgatagccctggacgtcgtcgaagcccaggaccacgtcgtcgaaggtgccgtttttatccggcaccttcaacgattgcaggacagcgccgtaggtgatgaccgtggcttgcaggccatggctgttgcgcaacacgtattgctcgacggcggtgccgtcgagggtcttgccaaaggccttgtgttcgctggacaggcctgcggcctgggcgccgaagctggcgagcagcagcgacaggccgaggctggaaagccggtggggagagtgcggcatggttgaacttccttttgttgttttgagtggaatagttctactaatttgcattattttgtcgatgtttcggcaaaattatcgcttaattcggcgtgtttacaatataaaataagactatttaagggtcgaatcgaaatgaatactgtgcgggaaccgtcatgatgaacactgaaaaaggggctggcatgcaggctgtgtacgcggatctcgagggcaagaccgtattgatttccggcggagcttccggaattggcgaagccctggtctgcgccttcgcacagcagggcgccagggtcgcgttcgtggacatggcgcaaagccagggcgaggcgttggcggcccggctatcggcgcagggccatcgcgtggagttcgcgcattgcgacatcaccgacgaggtcgcttaccaggccgcgatcgggcgctttgcacagacgctgggacccatcacggtgctggtgaacaatgccgccaatgacgtgcggcacagtctggaagaagtcgacgcgcaggcattcgacaagctcatttcggtcaatctcaagcacgctttttttgccagccaggcggtggtgccgatgatgaaggccgccggcgccggcagtgtgatcaacctgggttccatcggctggatgatggcctccagcggctaccccgtgtacgccgccagcaaggcggccacccacggcatgacccgggccctggcgcgggagttggggccctggcggatccgggtcaacaccctggtgcccggctgggtgatgaccgaaaagcaactggcgatgtgggtcgacgatgccgcccgcgagctgatcagccgcagccaatgcctgccgggcagcgtggagcccgggcatatcgcccagatggcgctgttcctggcgtccgatgcgtccgcgatgtgctcggcgcaaaacttcatcgtcgatggcggctgggtatagcgctcgacgaacgacgccgtggccctgccaggatggcagggcggggtgtcggcgagcggatgttcaggcggaaggcggctggacggtgcttaaggcgcagcgcagacagatagaccggcaaccgcccacggctgccggggcccaaggcgtcatgccggctgggttgagcggcatgcctggcctgttcatcgaccttcgatacgcagcggcaggctgtcgatcacctgagacagcgtttgctccagttccgcctcttctttttttacccgttccgggattcttcggcgctgtcggtattcgctggggctggcgcccgcgaattgcttgaaggcgcgggcaaagtaggacgggtccttgaagccgacttcatagccgatgctggtgatgggcatctggctgttgtcgagcagattcttggcgcaatccatgcgtttgctcaggatgtagtccatgaatcccaggccatggacctccttgaacagccggctgaagcgaaacgtggtcatgccgcaacgcttggccagctctttctggtcgatgctttcacgaaaattctgctcgatgtacagcagcacatcgctgagtgcctgatgtttctggtgctccacggtcagccggatgctgtccggcagggacgggccgtgttcgatctgcagcgtcttgtcgccggggccgctgctgtggcgcagttcgtagagctgcttcagcgcatgcaggaagcgccggatctcggcactcgagagagggagcaccatgtattcccagacacgcgagcgcatggcccagacggcgagttcttcggagtgctgcaccgtgaacatggcgatgggaatggagggaatcttgtgtttgatctccagcaacagattgagccctggcatgtccgggcggtcatagtgcatgcagatcatgtccggtagaggatgggtgtccttttcgggcagggacgcatctttcgacacctggcaatcgcaggctggacgaaacagcgcgatcagttcttcagaggatcggtcgcgggtgaggtcgaaccataaaagagagggtttttgggccgactcaggtctcatttccttattccttcctggtgtctcactgtcacttcctgggctgtcagtatcgccactgggctttgcgggcaaaggatcaagttctgataacgcttcataaattttcttgattaccttctatgtctgacagcgagataagagtcacaggcagctccttgctgttgcgatcgccttttcttgcaccaccggccatggctgaatcaatttagttttatatgagaacagttccttttctgaaaaaaactccctctaccaggtttagtttcattggtgttctttgctgtcttgccaagcattgcaaaaaagtcctagaaaccgacaataaactcctaactctttctgttagcccctgactaggattcagtcaggcggcacaaatactgatcgccttaaagcaacttttcttatatatgaggtgaacaaaatgaatctgcaaacaatcaaaacctcggtgctggcattcatcaaggacgaagagggtctgaccatcgtggaatacgccgtggccggtggtctgattacgctgggcgccgttgccgcgttcgtgaccctgggcggcaacgtggccaccgccatcaccagtctgggttgcgctgttcagggcgtggtgtgctaacgacagccgttgtgccgagtcttcagtcctgggcgggaactgcttgtcgctcgtacgcggccagactttttgggtctggctgcgacgagcggtttccctcgggctgaggccgtacctgtggtgcatgtgtgtttccgccgctgttctgtctgcgctcgcctggacaggatggagccttctcaatcggtatgtgcagtcagcgcacagtagatgacggatggctccagttctggtctcgagcgagtccaaattgtcaaagtgacctttggccgagcacggctccatcgctctgccgcggcctgaaaattctctttccagcttcaggagtatcgtcgctgtattgctcgcgtgaagatcaaatcctgatagggaagccccgggttacttcgtttcgcactatggtttgggtgcagcgaacacggccggggcttttgtctttgtcggccagtgctcaggccggacttgcatcgacggcgagattgtttcaaggcgactcttcaattattccttccttagataagccatctgttccttgtgttgttcctggtgtttttttgcatctttcaacaacagcaataaagtcctaacgatcagcaaaaatctcctaacccttccaatgcttccctgactaatgttcaaccaggcagtgcgacagtgctgctcttaaacaaaaacacttgagtgaggtgggaaaaatgaatctgcaatcgatcaagacttcgatcatcaagttcgccaaagacgaagacggcctgaccattgtggaatatgcagtggccggcggcctgatcactttgggcgctgttgctgcatttatcactctgggcggcaacgtggccactgccatcaccagcctgggatgcgctgtccaggggcaagtctgctaacgccaacttccaccgagggctgcagtcatgggcaaagagcaattattcgttgttgcattgatgctgggactgctggggattgcggtggtgagcgatcttcgtcgccaccgtattcccaacctcttggtgctgttggggctgggactggggattgccagccaggtctattcctcaggcgtcatcgggtttggttatggactgctgggcatgttgatcggttttgccgtttttctccccctgtacgcctttggcgggatggcagccggcgacgtcaagctcatggccatggttggcacttttctcactccgcaacacgccctctgggctgcgtttttcagcctgatcgccggcggcgcgtgcggggtactgatcgtgttggtacgtggtcaagttcaacagaccatggggcgctactggctgatgatgagagccagggcctatttttcgccggcggacgatgaagtggccggcaaaccctttccctattcggttgcgatcctgctcggcacattggccagctttttctggttgccccttggccagtagctcaggagaacattatgtacgccatcagtaacagccgtccgaccggcaatgaccgggaagcagtgcagcgactggctccacagccacgcacgatcctcgagaccgggctggccgacaatttcctgggagacctggtctgcaagcatttgcacgatgcgggtgtactggacatgcctcgactggtagagcgcctggcgctgacgggggcggtggttgaagaagtcctgaccttcctgcgtcaggatcgtcgggtcgaggtccttggccaagccggtggccagggcttgcgctacgggctgaccgagcgcggccgcaatgctgcccgggatgccttgtcgcgcagtggttatatcggcgcggcgccctttccggtgagtgcctaccgcacgctgctcaaggtgcagaccattcaccatggccgtatcagcgcccgggacatgcaggcttccttcggctccatggtgctggcgcagaacatgctcgatcagttgggcgtggccctgaactccgggcgcgccatcatgatttacgggccggcggggacgggcaagacctatgtcagcagtcggctgatccggctgttttccgagtccatctgggtgccccatgcgattgcgatcaacgatgcggtgatcgagatctacgacccccaggtacaccggcgtctggatgtcggcgatccgcagtacagcctgatgctcaatgaagggatcgaccgccggctcctgtgctgcgaacggccgatcgtcatcaccggcggcgagctgaccatggaacagctggatatccgctacgaccccttcactcgccagtacctggcaccgttgcagctcaaggccagcaatggcctgttcgtcatcgacgacatggggcgccagcgcatggcgcccgcggagttgctcaatcgctggattgtaccgatggaggagaagcgcgacttcctcaacctcggcggaggacggcactgcgagttgccgttcgacctgatcctggtgttttccaccaacctgaacccgttggaactggccgacgaggcgttcctgcggcggattggctacaagttgcagttcggctacctcaagcccgaggagtacgaacgtatctggattcaagagacagagcgcctgaacatccaatacgacccgctgctgttgcgctacgtcctggatgaactctatggcgttgaaaacatgccgctggtgccttgccacccacgggatctcttgagcatggcgctcgatcgccaacgttatctgggcgccagcggaccactgtcaatcctggaactggagtgggcatggcacagctacttcgtccagctcgactttctttgagtaaggagatttcgacatgagttctcgtactttcactctggtgaccctgtccgtggttctgggcctgggcgcggcatggatggccaacacctggctcaatgcacggctcaatgccacccccgacgataaccagcagaacgtggtggtggcgaccgtggaaatcgctttcgggcaaatggtcgagccacagcaggtcgcgctggtccggatgcccaaggagacggtgcccgatgatgctttcgatgcgaccgagaaggtggtgggcaagatcgccaccttctccatgctgcgcggcgacatcctgcgcggtgcgcgtctggccgaacacttgggtggcagcaccctggcgtcgctgatcgagcctaccaagcgcgcgatctcggtccgggtggacgacgtggtcggcgtgggtggtttcctgttgccgggtaaccgggtcgacgtgctggccacccggcagaccggcaatgacggcaatgccgaatccaagaccatcctggaagacctgcgggtgctggcagtggaccagacggccagtaccgacaagacccaaccggtggtcgtgcgcgccgtgaccctggaaatgaccccccagcaggccgaggaactggtcaaggggatgaccgccggcaagctgcaactggccctgcgcaacccgctggacaaccagaagcaaccggtgatcgccgagccggtcgcgatgatccaggacgtgcctgccccgccagtggttcggccgattgtccggcgtcgtgccagcggcgacagcgggatcacggtgattcgtgggatcgaggtcaacgttgtgaagtcccagctgtaaatgatcgggtacgacataaacgaataatgagggcttgatgatgagcgcgcgtatccaacagccattgagtgcttttccacggcagcagcgcggagccatgctcgtcctggtggtgattgccctggcctcgatgctgttaatgggggccctggcgctggatggcagccatatgctggtgaacaagtcccgcctgcaaaatgcggtggatgccgcggcactgagcggtgccaagaccctcagcacggtaatgggcgcgacaggggccgcgagcctggcgcagagcgccgcgctcaataccctgaccctgaatgccaatgccagcggcaaccaggagctggccaccgccatcggcaacaatgtcggcggctttgccacggtggagttggcgtctacggtctatgggcctttctctttcccggggccggccaatgcgagctatgtgcgggtgacggtcaccaactattccctggccggattcttctggggcgtctttcagaccctgggcaatggcgtcggtaacaagtttgtaagcgcggtcgctaccgccgggcccagccccgccagcccttgcgatctcacgccgctgatggtgtgcggcgacccgacgaaaaacagcccgtccaccggggtgttctgggggttcaagttcggcgatccgcagatgttgaaaaccgccgcaggcaacagctcgccgattggccccggcaacttccaattgctcgatttcggctcgggcggcagtacgaccaagcaggggttggctggcgctatcaaccagtgcaacaacgtcggttcgaatgtccagaccaagccggggaacaccgtcgggcctgcctcgcagggcctcaatacacgcttcaaccagtattccggcggtctcagcgcggcggactatccaccggacctggtgatcacaaccaaccccaagtcgttcacttacgacgatacgctcaagcagattcagtacaacagtcaggcggttacctccagcagcggtaatttgtccgcgggtggcagcgccttgtacgactacaacaactgggtgcaggactccgccaactgcgttgccggtagcggtggtggctgccagagcagcgggtcgttcgaacggcggatcatcaagatcgtgatcggtaactgcacgggcaagaacgacggatcgtcctcgataccggtgctgggtttcggctgctacttcgtcctgcaaccggcgtcgcaaaagggcaatgaggcgcagatattcggtcagttcgagagtgtctgcgaaggcgacaacgtgccgggtcccaacccggccaataccaccgggccgcagatcatccagctgtacaagacctatatcgacaacagccagacgccaagtaccgactcttaggaggctttatgggacgcagaggattcaggtcgccgcgcaaccagggcggattggcgatggtggagctggtattgacgctgccgctgctgttgttgctgatgctgaccttcgccgagttcggccgcatgttgttccagtacaacagcctgatgcacgccagtcgcgacgccgggcgttatgtcgctgacaaggcgtggaactccaccctcggcaagctcgacctgagcggcacgctgcagacccaggccaagaacatcgccgtctatggcgtgccctccaaccccaatggctacccggcggcggtgccggggctgacgccggcgaatgtcgcgatcagcgcggtgggggcccagcatgtccaggtcagtattacctacacctatgtgccggtgatcggcagtgccttgcccgccttgtatggcagcaacgtaccgctgggcctggccttgacttccactgtcgtcatgagggccttgtgatgaacgtcaaaggtatgcgtgggctgtacaccgtcgagttcgcgatcaccagcctggtgctgttcaccgtgctgttcggtgtgctggaaatgggccggctgtacttcacggtcaatgccctgaatgaaaccgtgcgccgcggcgcccgtctggcggcggtatgcgacatcaacgatccggtgattttgcgtcgggcgatgttcaacgcttccaccaacagcggtccgagcagcctgctcaataacctgacggccgccaacctgaacctggtttatctggacgccaacggcgcggtcgtcgccagccccaacgatctgagcggcaccggcggctttgtcgccattcgctatgtccagctacaggtatccaatttcagtttcaatctgctgattcctgggttcaacggggtgtttgtcttaccggtattcaggtcgaccgtgccacgtgaaagcctcggtcggcagccccaggcagcagtcacaccggagatcacaccatgttgagtacccgagaagcgcccgtcgctgccgctactgaaaagcaaggcaaacgcctgctgatcagtgggcgcgacgcgaccaccttgaatcacctgaaagcgctgagccaggggttgccgaacttgcaggtaaccactcgcctggtgagcaacggtcataccgatccgctgtatgggctggagcagatgcccgacttcctgctgttgcgcgtcagccatttgtggcgcgaagagctggcggccttgttgcagcatccgctcaaggagcgcccaccgctattggtctgcggtccgctggatgagcgcgagggcatgcgcctggcgatgcaggccggcgcccgggactttcttcccgagccggtagcggcagaagagttgcaggcggccatcggccgtatgctcatggaggccaatgcggagcaggggaccggtggcaagctgattgcggtgatgaacgccaaaggcggttcgggagcctcgatgctggcttgcaacctggcgcatcagctctccatccgcggtggcaggaccctgctgctggacctggacctgcagttcggcagcgtggcgcattgcctggatgtggtgcctacccacagccatgtggacgtgctgaagcaggtcgagtccctggacagcatcgccttgcgtggctattgcaaccacttcagcccggccctgcatgtgctgggcgggcgtaccggggagctgtgcctgacacaggatgtgcacctggatcagttggaaaaactgttgcgcctggcccgggggacctacgactgggtcgtggtggatctgccacgacagatcgatcacctcaccggcgtcacgctcgaacaggccgatcgcatctacgtcgtgctgcagcagagcctgagccacctgaaggacggcacccgcctgacccgcatcctgcgcgacgacctgaatgtgcagaacaaccggatacaggtggtggtcaaccgctacaacaaggcctcgccggtgagcctcaaggatattgccgatgccctgcgctgcccgaacccgcaaaccctgcccaatgactatgcggtggtcagcgagagccagaacaccggtgcgccgctcgagctgcatgcgccacgttccggggtgaccctggccctgcgtgaggtgacccagaacctgatcggaatcgaggtcgccgagaagagtttgttcaaacgtaccttcaatcgtctgttcggaggctaggccatgctcagcgactttcgtaatcgcctgcgtcagcaacccggtagacaggcaccggcagaaacccaggacgcgtccctcgacggtaaagagtgcgccagcgtgctcatggcctgggaggccagtgtgccggacctgatctatgaaaccaggaccaagctcggcccgatagagatcgaatggcgggaaaagatctaccagcaattgctcaaggtcatggacctgtcgctcctcgattccctggagccggccgaggccgggcggcagatccgcgacatctgccagcgcctgctcgacgagcattcggcgccggtcaattccagcagccgccagttaatcctcaagcagatcgccgacgaggtgctcggcctcggacctttggagccgctgctgaacgatgcgagtgtgtccgacatcctggtcaacggtcatgcctcggtgtatgtcgagcgcttcggcaagctgcaaagaacggatgtgcgttttcgcgacgaccagcacctgctgaatatcatcgatcgcatcgtttccagcctggggcggcgcatcgatgagtcctcgccgctggtggacgctcgcctgaaggacggttcgcgggtcaacgccatcattcccccgctggccatcgacgggccgagcatgtcgatccgccgcttcgccgtggacttgctcaacaccgagagcctggtgcagatgggcaccctgaccccgggcatcgccctgatgctcaaggccatcgtccgcggccggctgaatgtcctgatctccgggggcaccggcagcggcaagaccaccatgctcaatgtgttgtccagtttcattccgcacaacgagcggatcgtgaccatcgaagactcggccgagctgcaactgcagcagccccatgtggtacgcctggaaacccgtccgtcgaacatcgagggccgtggcgaggtgggccagcgggagctggtgcgcaacagcctgcgtatgcgcccggaccgcatcgtcatcggtgaggtgcgtggcgccgaggcgctggacatgttgacggcgatgaataccggccacgacggctcgctgaccaccatccacgccaacaccgcccgcgatgccctgggacggatcgagaacatggtgtcgatgacgggggcgacctttccgatcaaggccttgcgtcagcagatcgcttcggccatcggtgtggtcatccagctggagcggcaggaggacggcacgcggcggctggtcagcgtgcaggaaatcaacggcatggaaggggaaatcatcaccatgaccgagatcttctctttcgcgcgcagtggtctgggcgagaaaggcgaggtcctgggcgaattccgccccaccggcatggttccggcgtttcgcgatgtgctggccaaacggggcatcgagctgccgctcagcctgttccggccagactggatggagggctagtcatgcatcagatccccagcgagttcatcctggcgtttctcggcatggtgttcaccgccatattcctgctcagccagagcgtggcggtgccggtgttcggcgaggccggcaaggtgcgcaagcgtattcgcagtcgcctcgacctgctggaacgggccagtaacctggagaacatgcagtcggtactgcgccagaaatacctgcgtcgcctgtccccgctggaggcgcgcctggaacagttgccggcgatggaggccctggcgcagatgatcgagcaggccgggcatgagtaccgcgcctatcgggtactgatgctcagcctggtcctgatgatggtggctggcatggggacgtggctgttcacgcagctgtggtgggcggcgctcccggctgctgctatggccttctggctgccggtgttgaaaatctcccgggaccgcaacaaacgctttgccctgttcgaggagcagttgccggatgcgttggatgccatgtgccgggcgctgcgtgccggacatccgttcaacgaaaccctgcagttggtggccgacgagcacaaggggccggtggcccacgaattcggcctgacctttgccgacatcaactacggcaacgatgtgcgtcgggccatgcttggcctgctggaacgcatgccgagcatgaccgtgatgatgctggtgaccactgtgctgatccatcgcgagacgggcggcaacctgaccgaggtactggatcgtttgagcagcctgattcgcggccgcttccgctttcagcgcaaggtcaagacgctctcggccgaagggcgcatgtcgggctggatcctggtggcgatgccttttgtactggcggcggggattgtgctttcgagcccgacctatctgcctctgctcatcaatgagccgctgggacagaagatggtgcttggcgcgtttgtggcgatgctggtgggaatcttctggatacgcaagatcatccggatccaggtgtgagcacaatcactcgtagggggtgaggtcatggagtatctgctgagtctgatccaaagtgtggtcggtagcgagcaactgacgcgcctgctgttcgccggggccatcggcctgagcgtggtgctggccgtggcgaccctgatattgctggtgcaggggttgcaggacccggtgcaccgccgtcttctgctgatcaagcgcggtcatggcggcgatggtcaccggcagcagggcgcgccgagcaacctgcaattgatgctggagcaggtcggccagcgttttgcctccggtgaacaggagcaggcctcggcgacccggaccttgctgatccatgcgggctttcgctccccggccgctgtccagatgtactgggcggtgcgcctgctgacaccgttggcattggtggcgctggcggtcctggcgctgccgctgataccgaaggtatcgctgcttctggggatggggctggtgatcctggcgctgggggtaggctggctggtaccggccatctatatcgacagccgcaggaacgcgcggatgacccgtttgctcgtcgcttttccggatgcgctggacttgatggtggtctgcgtggagtcaggccttgccttgccccaggcgatcgagcgggtatcggaggagatagcggtcagccaacctgagctggccatggagctggcactggtcaactccgaggtccgggccgggattcccagtaccgaagcgctcaagcatctggccgagcgtaccgggctggaggacattcgcgggttggtgagtctgctggcgcagagcattcgcttcgggaccagcgtggggacgaccctgcgtgtctatgccgaggagtttcgtgaccggcgcacccagcaggccgaagagaaagccgcaaaaatcggcaccaagctggtgtttccgctgatcttctgcctgtggccaagcttctttctggtagccatagggccggcgatcatcggcgtcttcaaagtattcgggaagttatgaaagaggggaggggcaagggccatcggcatggatggcattgccccctctgaactgaacaccatcgcgacttgctgtcacttcgaaccacctgacccacccgaacctacatactccttgtagtactcggggatcgggtgtttgtagttgtccagccagcgctgcagggtcagttcccgttcgctgggcgaggcgttctgcgggatgggcgacttgacctggttacgactctgcagcagcagccaggtttcggtcgactgttgtgacagggaggccgggccgggttcgatagcctgggtcaccagcggaagaagcaagagtcccaggcagctaagcgtttggtatttcatcactacctctgcgttattggttgattgacagtcgatggcgacgaatctgtggcagtgactgctttatcgttagctgacttcttcgtcgtgttcttgagtttttcggcccgctccttggcgctggtgacttgctcggggttcaggccggcctgattgaccaggtccgaggcctgtttccagttgccttgataaatcagcagggtcaccaggttgagggttgccaactggttgtcctgtttcagttccatggccgtgaggaactcaaagcgggcttgcctggtattcccctggttgaggtagaccactcccaggtcgttacggattttctcgtcggtgggggacaggcgcgccgctcgagtcaggtgttccagggccagcgcgttatcgttgcgtgaggctgccagttggcccaggccatgctcgccttcggcgaccaggcaggtgctgagcaggctgcggtacagcggttcggcctcgctttggccgagctggcgatagaccttggccttgcgcatgcgcacctgtggcaggtcttccggcaggcgttgcagattggccaggccggcgtgcagcttgccttcgccgatcatgtcgtcggccaggctcagcgacagttcctgatccgaatccagcttgctgcaggcctgcttcgaccagctaccgccgccattcgtggcgcagccgctgagcatgagcagccctaacgccgcaatgactactttcatttttccctcctggaacaatccgattgtcgaggaatggctaacaccggacttgccgagtccggtgtcattgagcctgagtgtggcgagcaacgaaccaggtccctggttcattgcgaaagcccgctggcggcctggtcaaaattgccgttttccaggaagtacagacggaaccagttcgggtcgtagttgcgcagtggctcgccaggcagtactggcagcttggcattgaccgccagcggttgcaccagatgcggagtgacgatcatcagcagttctttctcttcgcgcctgatcgaagaatcacggaaaaatgcccccaggatcgggatctctcccaggccggggaacttgctcacggccgtgctattggtggtgctgatcaggccgctgatcacgaaactctcgccgtcggccagggagatgctggtgtcggtgcgacgcacaaccagggctggcaccgagatatcgttgacggtaatcccgttggtgaagtccaactcgctgacttccggggcgaccttcaaggcgatgcggttatttccgacgatcgtgggggtcagggtcaggcgaataccgaattccttgtactggatggtaatactgtcgctgccgctgctggggaccgggatcggcacttcaccaccggccaggaagcttgcgctctgtccgctcagtgccaccaggctcggacgcgccagggtataggcaaacccactgccttccagggcgttgatcagcccaaggacgttaccgccgccaatgccgatattaaacatgccgttgttgagcggtatgttcggcctgaggccaccgatattgccgggcgtcaccgtcgtccccaacggggcggtgcctggggagctgaacaggaagttaccgctcttgccgaagatcgaggtgccggcctctttcagcttggtgcggctgacttcgacaaagcggatatcggtctgcacctggctggccagggacggatcttcggaggggggcaatagcgaactcaccatcgaatgagggcctttgccctgaacgaacaccatgctctggcggggttccttgtcgcatgccgtccagaccatcaggctggttgcgccgggcgcgatgccagtcagcaggtatgaatctcgcccattgagatacacatcggcaattttcgggtcgcccacggccagtcgggtaatggcaacgggggagtgcattatcgtctgctgaccctctcccacttccaccgtcgacggcagtggctgcaatccagcgcagttatttgacgccgccatggccattcctgtgggaagaccagcgacaatcaatgtccacgccactctcctgagcacctgtacacaatcactgttcatgcactgcatccttgtttgggctgggggaaaccgccagggccggtcagcagggatcatctctccgtcatctgaaccagagcccaccaagtgttgctgcaaccaaccagcagttagctgtttctgtaactgacgttagcgcagaaaggtaaaattgctatgaagtgtaaaaaaacgcttggtcgatcgaggggattcaccgccaggccgagactcgcctgcatgcaatgcgcataaatggtgcaagtgcgcattgcgcgtcactgaaccgtttgcgctgtcgaggctgcaattggcaggctttcatgcccttgaccgatgcctgctccatgccggggcgagccgtgtgacgcaggtcagaatcatcttttacatcaaggggatattctgtagccttgcgcagtttcaacgctgcacctacctgatgaatactcactctcccggcggtaccctcaatgggtccggagccgggtgtatactcgactttcgcgcataagcgcccgcaggtcttgcgatcatgacgcacatttccgaacgccttctggttcaggcccaccttgacgccaaacagcccaaaccgctgacggccgcagaggaagcccattaccgtgccgcgattgctgccgagctcaaggctcaggacgccgtgctggtggctcacttctactgtgatccggtgattcaggccctggccgaagagaccggcggctgtgtgtccgactccctggaaatggcccgtttcggcaacgctcacccggccaagaccgtggtggtcgccggtgtcaggttcatgggcgagacggcgaagatcctcaaccccgaaaagcgggtgctgatgcctaccctggaagccacctgctccctcgacctggggtgcccggtggaagagttctcggcgttctgcgaccagcatccggaacgcaccgtggtggtctatgccaacacgtcggcggcggtcaaagcccgcgccgactgggtggtgacctccagttgcgccctggaaatcgtcgaaagcctgatggataacggcgaaaccatcatctgggggccggacaagcatctgggcacctacatccagcgccagaccggtgccgatatgctgctgtgggacggtgcctgcatcgtccacgaagagttcaagtccaagcagttggaggatatgaaggcgctgtatcccgatgcggccattctggtgcaccctgagtcgccgacgtcggtgatcgagctggccgatgcggtgggttccaccagccagctgattgccgccgcgcaacgcttgccgaacaagacgctgatcgtggcgaccgaccgcggcatcttctacaagatgcagcagctgtgcccggacaaggtgttcatcgaggcgccaacggccggtaacggcgcggcttgtcgcagctgcgcccactgcccgtggatggccatgaacactctggagcgcaccttgcagagcctgcgtgagggctgcaacgagatattcgtcgacccggcgttgattccccaggccattcgtccgctcaagcgcatgttggatttcactcaggcggcgcggatgaagctggcgggcaatgcctgatcgccttcgacaagcgcacagaaaaacgccccgagattcggggcgtttttctgtgcggcggattattttttctgcttgggaatgcgcacgatctggctggaagagtagatgtcgtgccaactgcgcttctgcttgtctaccaggatccagatgaaacccagcccggcgcacagccaggaagcgatcgagaccatgaagcgcaggagggcctgccacaggctgatgcggctgccgtcggcgttctgcacgcgaatgccccagacctgcatgcccagggtctggccggaatgggtccagaacttggcgaagaaggcgaacagcacgaacagcaggacggtggagtagaggggatcgccgtccagggcgccggattcggtcagggtgcgcatccgggtttcaccgaggatctgcagctggatgaacttgtagataccgcccgtgacgatcagcagtgcggtgcacagtaggaaatcgtagaacatcgctgccagacgacggcccaggccagcggcggggaaatcgccctggggggttagcaggtgctttggcatcacaggcctctcgatcgaagaaagaagccattttacggaattgcgcgtacaaaaaagcccctgatgtcagcatcaggggctttttcgttacagacgatcagccttcggcttgaacttcgtcagcctgcatgcctttttggccctgcacagcgatgaaggtcactttctggccttctttcaggctcttgaagccgttgccctgaatagcgcggaaatgcacgaacagatccggaccgctttctggagtgataaaaccaaaacctttctcgtcgttaaaccacttgacggtaccgctctgacgttgggacatttcttatttcctttgacgctaaaaaattaatgacagtctctttctcatgaaggagtactgggctgggttgcaggaaagtaagagacgtcgaacgggttgtagcaaacttgttagctactgcccaggtcacgattccaagcgacccatgcaaacacagtggggaaactctacgccaactacgggagaaaaaacaagccctgcgaaaccccggttttcctcagcttggtggctgtttgccggaactaggcatctgggcttattcgatagggtcgttcaattgttttcaactgttataaggcaagttcaatatcgaaaatatgcactattttatggcggttgcgttacagattagtgcacttttaacgcaaccgcgttacttatagaaacagttgatcaaccacgatagtagcgttgtgcaacgaatggcattttgcttacaagcattggcacctttttcccacgaacaattgcccaaactggcgtatcgagtgcgacataagcgctatcgatgtaacccatggccaacggaccacccagggtcgggccaaaaccgccgctgcagacactaccgatcacctcgcccgcttcgtcgacgatctccgcgccttcacgcaccggtgtgcgttcctggggcagcaggccgacgcgtttgcggctcacgccattgagctgttgggcgaatacctgttccgcgccagggaagccgccagcccgcgcgccatcggcgcgccgtggcttggagatggcccacagcaggctggcttcgatcggcgtggtctggctgttcatgtcatggccatacaggcacaggccggcttccaggcgcagcgaatcccgggcgccgaggccgatggcggccacttctggttcggccagcagggcgcgggccagggtttcggcgtcggccgccggtaccgagatttcgaaaccgtcttcgccggtgtagcccgaacggctgacaaagcagtccacgcccagcagcttcacgcgggtgaattgcatgaaggtcatcttcgccactgccggcgccaggcgcgccagcacggtgacggccgccgggccttgcagggcgagcagggcgcgctcctcgaacagcggctcgatgctgcacaaatggccgatgtgctggcgcagatgggccaggtcctggtccttgcaggcggcgttgaccaccaggaacagttcgtcgttgcccaggttggcgaccatcaggtcgtcgaggatgccgccgttttcattggtgaacatggcgtagcgctgcatgcccacgggcaggtcgataatgtccaccggtaccagggtttccagggcctgggcggccttggcgccggtcaggcggatctggcccatgtgcgagacgtcgaacaggccggcctgctcgcgggtgtgctggtgttctttcatcacgcccagcgggtattgcacgggcatgtcgtaaccggcgaacggcaccatgcgcgcgccgagttcgaggtgcagcgaatgcagcggggtcttcaacagtgtttcggtggacatgttcagctcctgggtaaacgtgagacgcgtatgtgcgtgcatcagcactcgatgatgttgacggccaaaccgccgcgggcggtttccttgtatttgcttttcatgtcggcgccggtctggcgcatggtgcggatcaccttgtcgagggagacgaagtgttgcccgtcgccacgcaaggccatgcgcaccgcgttgatcgccttgaccgagcccatggcgttgcgctcgatgcagggcacctgcaccaggccgccgatcgggtcgcaggtcaggccgaggttatgttccatgccaatctcggcggcgttttccacttgttgcaccgtaccgccgagcacttcgcacaaggccccggccgccatcgagcaggccacgccgacctcgccctggcagccgacttcggcgccggagatggaggcgttttccttgtagagaatgccgatggcggcggcggtcagcaggaaacgcaccaccccgtcttcgttggcgccggggatgaagcgcatgtagtagtgcagcaccgccgggatgatgccggcggcgccattggtgggcgcggtgacgacgcgcccgccgttggcgttttcttcgttgaccgccagggcgtacaggttgacccagtccagtaccgacaaggcgtcgcgcagggccgcctcggggtgcttgcacagctggcggtggagggcggcggcgcggcgcttgaccttcaggccacccggcaggatcccttcgttgcggcagccggcatccacgcagtcctgcatcacttgccagatcttcagcaggccggcacgggtttccgcttccggtcgccaggcactttcgttggtcagcatcacctggctgatcgacagcccataggtgctgcagtgaccgagcaggtccttggcgctcttgaaggggaaggtcagtttggtggtgtcttcgacgatgcggtcggcccccgcggcgtcctcgtcgaccacgaagccgccgcccaccgagtagtactcgcggctgcggatctgcaatccggcggcatcgaaggcacggaagatcatgccgttggggtggtaggccaggggcttgcggatcatggccaggtgttctttctcgttgaacgcgatgaggtgttcgccgagcaggttcaagcgtccgctgctgcgtatttcctgcaggcgagcggcgatgttttcggtattcacggtatccgggtgttcaccttccaggcccaggagtacggccttgtcgctgccgtggcccttgccggtggcgccgagcgagccgtacagctcgaccttgacgccggtggtggcgtccagcagtccgtcgcgccgcaggccttcgacgaagcgcgcggccgcgcgcatcgggccaacggtgtgggagctggaggggccgatgccaatcttgaacaggtcgaacacgctcaaggacatgttggttctccggtttcttattgtgttgatcggcacgcattttttgtaggagcgagcttgctcgcgatgaacctgagggcaccgggttgttccggtgctccgcgttatcgttcacgagcatcgcgagcaagctcgctcctacaggtatacgcagtatctgtaggagcgaggcttgcccgcgatggacggcgatgccgtcttaggcgtcctgataactttcgatcgacgggcaggcgcacaccaggttgcggtcgccgaacacgttgtcgacgcggccgaccggaggccagtacttgccttcgatcagcgaggccacggggtacaccgcctgttcacggctgtaggggtgcgaccactcgccaacgatttccgctgcggtgtgcggggcgtttttcagcgggttgtcgtccttgtccaggctgccgttttccaccgcgcggatttcttcgcggatgcggatcatggcgtcgcagaagcggtccagttcttccttggattcgctttcggtcggctcgatcatcagggtgcctgccaccgggaacgacatggtcggggcgtggaagccgaagtcgatcaggcgcttggcgacgtcgtcgacgctgatgccgctgctgtccttgagcgggcgcaggtcgaggatgcactcgtgggccaccaggccgttgctgccggtgtagagcactggatagtgttcttccaggcgacgggagatgtagttggcattgaggatcgccagctgcgaggcacgcttgaggccttcgccgcccatcatgcggatgtacatccaggtgatcggcaggatgctcgcgctgccgaacggcgcggcgcagaccgcgccttccttgcgttccatggccgcgtggccaggcaggaacggcgccaggtgcgacttgacgccgatcgggccgacgcccgggccgccaccgccgtgggggatgcagaaggtcttgtgcaggttcaggtgcgacacgtcgccaccgaacttgcctggggcgcagaggccgaccatggcgttcatgttggcgccgtcgatgtacacctggccgccgttgtcatgaatgatgccgcagatttcgcggatgccttcctcgaacacgccatgggtcgacgggtaggtgatcatcagcgcggcgaggtgctcgcggtgctcgatggccttggcccgcaggtcttcgatatcgacgttgccacgggcgtcgcaggcggtgaccaccacgcgcatgccggccatgttggcggtggccgggttggtgccgtgggcggacgaagggatcaggcagatgtcgcgacggtcgtcgccgcggctctggtgataggcgcgaatggccagcaggcctgcgtattcgccctgggagccggcgttcggctgcagggacaccgcgtcgtagccggtggcggcgcagagcatggcttccagttcggacgtcagttgctggtagccggcgctttgctcggccggggcgaacgggtgcagggcgccgaattcggcccaggtgatcgggatcatttcgctggcggcgttgagcttcatggtgcacgagcccagcgggatcatggtgcggtccagggccaggtccttgtccgcgagcttgcgcaggtagcgcatcagctcggtttccgagtgataacggttgaacaccgggtggctgaggatcgccgactgacgcaccagcgccgccgggatatggctctgtaccgtactggccagcgcggcgaagtccggcagcgcctgaccgtcggccagcaggctccacagcgcttgtacatcggcctggccggtggtttcgtccagcgacagacccaggcgctcggcgtcgatcacccgcaggttgatgcgctgggcgcgggccttgtcgtgcagcgccgcggtgcgtgcgccggtgtacagggtcagggtgtcgaagaagttttcctgctcgaccttgatccccagcttgctcaggccctgggccaggatcgcggtcagctggtggatgcgccgggcaatccggctcaggccttgggggccgtggtacacggcgtacatgctggcgatattggccagcagcacctgggcggtgcaaatgttgctggtggctttctcgcgacggatatgttgctcgcgggtctgcatggccaggcgcagcgccggcttgccgaaacggtccacggacacccccaccagacggcccggcatgtcgcgcttgaacgcgtccttggtggagaagtaggccgcatgcgggccaccgaagcccagcggcacaccgaagcgctgggcgctgccgatggccacgtcggcgccgaattcacccggtggggtcagcacagtcagcgccagcaggtcggcggcgaccgccaccagggcgttggcggcgtggaagcgctcggtcagctcgcggtagtcgaacaggtcgccgttgctcgccgggtattgcagcagggcgccgaagaacgggctgacgtcggtcagcttgcgctcgtcgccgaccaccacgtcgatgcccagcggctcggcacgggtgcgcagcacgtcaagggtctgcgggtggcagtggctggaggcgaagaaggcgtggctgcccttgttcttgctcaggcgcttgcagaaggtcatggcttcggcggcggcggtggcttcgtcgagcagggaggcgttggcgatcggcaggccagtgaggtcgctgatcagggtctggaagttcagcagcgcttccaggcggccctgggaaatttctggctggtacggggtataggcggtgtaccaggccggattttccaggaggttgcgcaggatcggcgacggcgtgtggcagttgtagtagccctggccgatgtaggtcttgaacagctggttcttggcggcgatggccttgatcgaggccagtgcgtcggcttcgctctgcccggcgggcaggtcgaggacgctggtgcccttgatgctgtcggggatcacgctggcgctcagggcttccagggagtcgaagcccaggctgttgagcatggcttgctcgtcgccttggcgcgggccgatgtggcgcgcgatgaattcgttggcggtgctcaggttgacttgagtcatggcggttcctcaggcgtcggcgttggctttgatcaggcggtcgtaggcgtcctgatccagcagttggccgacagcggcggcgttcgcgggaatgaagcggaagaaccagccttcgcccagcgggtcttcgttgaccagctcggggctggtttccagggccgggttggtttccaccacttccccgtccaggggcatgtacacgccgctggcggcttttaccgattccacggtggcggcttcggcgcccttgtcgtaggcctgcagttccggcaattgcacgaacaccacatcgcccagggcgttttgcgcgaaagccgtgatgccgacggtaacgctgccatcggcttcggtacgcagccattcgtgatcttcagtaaaacgcaactcgctcatggaaactcctcaaggggccagattcgtctggtggacgcgattgaatgctcgtgcagggccgagcggaatggataagcccttagcaaaaatgcggccaatgttttttagttgttattaatcaatgagttatatgttcttggtggtggtcggaagctaacggctgtagcgaaaacgctacagctggagggccaggaaaaagcctatggggatcaaagccttgcgtagcgccgattacaactggttgtagcgatatcgttccgctgtagcgctttcagtacaggtggaggtcgctttcagatgcggctacgccacctgtaaccgctgccgcaggtgcgataaggccgaaggccttcggcgatcttgagatcttgcgctccctgcgggagcgatcgcagcctgcggcagtggctacaacatcaagagccgcggcggctcagggcttgttggggatgccgtatttgcgcaggcgatgggcgatggcggtgtgggaggtctgcaggcggctggccaactggcgggtcgaggggtagttgacgtagagaccttcgagcagcgccttctcgaactcctcgacggcctgttccaggctttcgacttcggtgtcgttctggcgcgccaccgaggtgccggcgatatccaggtcgccgatgtccaccaggctgctttcgcagatcgccgccgcgcggaagatcacgttctgcaactggcgcacgttgcccggccagcggttgcccagcagcgccggataggtgccgggcgccaggcggcagaccgggcgctggatctgcgcgcaggcctgctgcatgaaatagcgcgccagcaacaggatgtcctggccgcgctcgcgcaggggcggcacttctacattcagcacgttgaggcgatagaacaggtcttcgcgaaagctgccctcggcgaccatcttttccaggtcgcgatgggtggcgctgaggatccgcacattgaccttgacctcacggtcgccgcccacccggcgaaagctgccgtcgttgagaaagcgcagcagcttggcctgcaagtagggcgacatttcgccgatctcgtcgagaaacaccgtgccctggttggccagctccatcagccccggcttgccgccgcgctgggcgccggtgaaggcgccgggggcgtagccgaacagctcgctttcggcgaggttctccggcagggcggcgcagttcagcgccagaaacggcgcgccgtgccgcgcactgatggcgtgacaggcccgcgccaccagctccttgccggtaccggtttcgccctggatcagcagtggggcatccagcgcggcgacgcgctgggcgcgggccttgagggtgcggatggccggggagtcgccgagcagggcatcgaagccttcggcatggtcgtggtgcagggccgacaggcgttcgccgatgcgattgggctgatacagggtcagcagcgcgccggcgtcggtgatcggtgtggcatccagcagcagggtctggccattgagggtgatttcccgcaggggcaggcgaaagccctgttccagcagggtttccagcagcgccgggtcgtcgaacagctcggccacgctttccccggccggctcgcggccatagagggcaatcagcgccgggttggccagcagcaccttgccggcgctgtccagggccagcaccgggtcggtcatcgccgccagcagggcgtcgagctgcaggtggcggcgctggccgggcaggatgtcgaccaccgtcaccgctgcacgccgcgcacgctgaacagcgcgtcgcgcagttcttccagcacttgcgggctgagggtcggggcgtcgatgtagacgttgggcggcaccatctccaccgcatccaggttgaggttgcgcccaccgagcagggccaggacttcctgggtgataccgacgcggtcgataaagctgacgtggatgcgcatggggcggtcaagggttctggaaaacggagggtggcaagtatgccttggcgagaggggtttggtgaaatgcaccgcacggtccgtcggggcttctgcaggagcgaggcttgcccgcgatgaactcaaggacgccgcggcgtatcaggccaggcttcccgcgtcatcgttgtggctatcgcggacaagcctcgctcctacaggttaagcgggcaggggaagcccgcgacccacgggctggggttattcgaggtgttcgggtttgactggatccccggatttcatattcagctgcacccgcacgtcctcaaacatcgcgtcgtaatatttgtgcagcgagccgatgccgctcagtgccttgggaatcccatacttctcggcgattttcgtcacgttgctggcgaagttgtaagcctgatccttgggcagaaagaacggttcatcgagctctttgccctgaatcgttccatgcatcttgaactgcatccctttgccttccttggggtcctgcgcgacttcatagtcgatacaaatgttgtagctgacatcgtccttggtcagtgcgtgtcgctcgatgtgtaaatgaccgggttcgaactgggccatggctctctcctttcaaggcatggggagcggtgcaggccagcggcctgcaccctgagttgctcttatcggtaagtgatgcccggctgggcggtgctgatgcgcgtaccggccttgccctggacgatcgcttcgatgtccgagagtgaaccgatcaccgcgacttttccagtatggcgggcgaactcgcaggccgcctggaccttcggtcccatggagccggcggcgaagccgagcttttccatttcgtccgggtgcgcctgggcaatggctttctgcgacggcttgccccagtcgataaaggccgcgttgacgtcggtggcgatcaccagcagatcggcctccagctgttcggccagtaacgccgagcacaggtccttgtcgatcaccgcctcgatgccccggagcttgccgtcctcgccgtacagggtggggatgccgccaccgccggcgcagatcacgatgctgctcttttccagcagccatttgatcgggcggatttcaaagatgcgcttgggtttcgggctggccaccacgcggcggtacttgtcgccatcgggggcgatggcccagcctttttccttggccagtttttctgcttcgtccttgctgtagaccgggccgatgggcttgctcgggttctggaacgctggatccttggcgtcgacctcgacctgggtcagcagggtggcgaagggcacttcgaaatccagcaggttgcccagttcctgttcgatgatgtagccgatcatgccttcggtttcggcgccgagcacgtccagcgggtaaggcgacaccgaggtgtaggccgccgcctgcagcgacagcaggccgacctgcgggccattgccgtgggcgatcaccagctggttgccgggatggatcttggcgatctgttcggtggcgatgcggatattggcgcgttgattgtccgcggtcatgggttcgccccggcggagcagggcgttgccgcccagtgcgacgacgatacgcataatgcattccttccagaattcggtgatcccgtgggagcaagttgcgcccccacggacgtcggggttacaggtcggccagggtcgagaccaggatcgccttgatggtgtgcatgcggttttccgcttgctcgaaggcgatgcaggccggcgactcgaacacgtcatcggtcacttcgatgccgttggccaggtgcggatactgctcggcgatctgcttgccgaccttggtatcgctgttgtggaacgccggcaggcagtgcatgaacttggtccgtggattgccggtggccttcatcagctcggcgttgacctggtacggcagcagttgctggatacgttcggcccaggcttccaccggctcgcccatcgatacccagacgtcggtgtggatgaagtcgacgcccttgaccgcggctttcgggtcttcggtcagggtgatgcgggcaccgctttcttgcgcgtactgcttgcagcggctgaccaggtcgtcatggggccacagggcctttggcgcgcagatgcgcacgtccatgccgagcttggcgcccaccagcagcagggagttgcccatgttgttgcgggcatcgcccaggtaggcgtagctgatgtcgtggatcggcttgtcggcgtgctcacgcatggtcagcacgtcggcgatcatctgggtcgggtggtattcgtcggtcaggccgttgaacaccggcacgccggcgaacttcgccagttcctcgacgatttcctgcttgaagccgcggtactcgatggcgtcgtacatgcgcccgagcacgcgggcggtgtccttcatgctttccttgtggccgatctgcgacgagttcgggtcgatgtaggtgacgttggcgccctggtcataggcggcgacctcgaaggcgcagcgggtacgggtcgaggttttctcgaagatcagggcgatgttgttgcccttgaggtgctgttgctcggtgccggtgtacttggcgcgcttgaggtcgcgggacaggtcgagcaggtagcgcagctcgcgctcggtgtggtgttcgaggctgagcaggttacggttgtggatattgaacgccatgatgattctccagggattctgtaatcggcccggccagcaccgcagaggtgcggccggggggaaagtcgtttagtaatcgatcgggtcgcgcacgatcgggcaggtcatgcagtggccgccgccccggccgcggccgagttcgccggcgctgatggtgatcacttccacgccggccttgcgcagcagggtgttggtgtaggtgttgcggtcatagccgatgaccacgcccggctccagggccaccacgttgttgccgtcgtcccactgctcgcgttcggcggcgaagctgttgccgccggtttccaccacgcgcagttgcttgaggttcagggactcggccactacctcgaggaacgatttgttctcccgtcgcacgtccatgccatagggcttgctggtgtcgggacggatgacgaacggcacgatttccttgaccacttccgggaagaccgtgaccaggtcgcggtcgcagaagctgaatacggtgtccaggtgcatcgccgcgcgggatttcggcaggccggcgaccacgactttttccaccgcgcccttggcgaacagggattgcgcaagctggccgatggcctggcgcgaggtccgctcgcccatgccgatcaacactacgccattgccgatcggcatgacgtcgccgccctcgagggtggcctggccgtgatccttgtccgggtcgccgtaccagacttcgaagtcggcgttggcgaactcggggtggaacttgtagatggcgctggccagcagggtttcctggcgccgggccggccagtacattgggttgagcgtcacgccgccgtagatccagcaggtggtgtcgcgggtgaactgggtgttgggcagcggcggcagcaggaagctggagtggcccaggtagtcgcggtacatcttgatcacgctggcgccttcgctttccggcaggtcctcgccggccacgccgccgatcaggaactcggccagcttgcgcggctccaggctttcgagccagctgcgcacttcgttggtcaggccgacgccgacggtgtcgggggtgatcttgcgatccagaatccacttcagggcttcggggttttgcaccgtatcggtcagcaggttgtgcatttccaggacttcgatcccacgctcgcgcattttggtaacgaagtcgaaatggtcgcgcttggcctggttgacccagatcacatcatcgaacagcagttcatcgcagttgttcggggtcagccgctgatgggccaggcctggggagcaaaccatgactttgcgcagtttgccggcttcggaatggacgccgtacttaactttttccgtggtcattaccgtgatcctccagaggtagaaacaatcgtgcggttacagggtcaggaagccgtcgtagagcccgtaggcggccaacagggcgcctatgattactgcggcgaaaatcagcttctcgacgttggtgaaaatcggtttgcccaactcccgcttggccttggcgaacaggatcgcgccgggggcgtagagcagggcggagagcagcaggtacttgaccccgccggcgtacagcagccagatcgcgtagagcagggcgatggagccgatcaacaggtctttcttgcgttcggccagggccgcttcgtaggtttcgccacgcaccgccagcagcacggcataggccgccgaccacaggtagggcaccaggatcatcgaggtggcgaggtagatcagcgacaggtaggtactggccgagaacagggtgatgaccaggaagatctgcaccatggcgttggtcagccacagggcattgaccggcacgtggttggcgttctcgcggcgcaaaaactccggcatggtgtggtccttggccgcggcgaacatgatctccgcgcacagcagcacccacgacagcagtgcccccagcagcgagatgatcaggccgacgctgatcagcaccgcgccccagtggccgaccacatgctcgagcaccgccgccatcgacgggttctgcagcttcgccagctccggctgggtcatgatgcccagcgacagcacgttcaccagtaccaggaacagcagcacggtgatgaagccgatcacggtggccttgcccacgtccgagcgtttttccgcgcgggcggagaagatgctcgcgccttcgatgccgatgaacacccacacggtgaccagcatcatgttgcgcacctggttcatcacgctgcccaggtcagggttcttcacgccccagatgtccgcggtgaagatgtccagcttgaaggcgaacagggcgatcagcacgaacagcagcagcggcaccaccttggcgaccgtggtcaccaggttgatgaacgccgcttccttgatcccgcgcagcaccagaaagtgcacggcccacagcagcagcgaggcgccgatcaccgcggcaggagtattcccctccccaaatagcgggaagaagtagcccagggtgctgaacaagagtacgaagtaccccacgttgcccagccaggcgctgatccagtagccccaggccgaagaaaagcccatgtaatcgccgaaaccggccttggcataggcgtagacaccaccgtccagatcaggcttgcggttggccagggtttgaaacacgaaagccagtgtcaacataccgacagcggtaatagcccagccaataagaacagcgcctacatcggcacttgccgccatgttttgtggcaaggaaaagatcccgccgccaatcatcgagccgactaccaaggcgactaacgcaccaagccgtagttttccgggagtgtcagacattgcgtgactccattgcaggagaagagagacgtcagagtaaatctgcgagaaatccgaacagctgatttagatcaggtcattgctacattccattgtgaatgaacgacttaagctgtctttgcggaaaccggtgggaagcctgaaagcgccattccataaggcctctggttccagatgaaaggtcttctcattggcgccagattgaaactagtccgctttccagaatgcgcaactcattaaaaagttataaggctgaccggcgcgctgatggcatttgggttttatccataataaaaacccaactattcaatatgttctgatcctcgtcatgtcgatggctccacaaaagatcaataattgactcttttagtccgtttccaatctatggaagttaactaatttcatatagtttgttgtcggacaattggaccggacgcagaggtaggcatgccacaaaccacacaaaaactgcgactcggcgccctgatcgccctggtggtggggtcgatgattggcggcgggatcttttccttgccgcagaacatggcggcccgggccgacgccggggcgatccttatcggttgggcgatcaccgccgtgggcatgctgaccctggccttcgtgttccagaccctggccaaccgcaagcctgaactcgactccggggtgtacgcctacgccaaggccgggtttggcgactacatgggcttttcgtctgcctggggctactggatcagcgcctggctgggcaacgtcggctacttcgtactgctgttcagcaccctgggttatttcttcccggtgtttggccagggcaacaccccggtggccatcgcctgcgcctcggtcctgctgtgggcggtgcatttcctggtgctgcgcgggatcaaggaagcggccttcatcaacctgctgaccaccgtggccaagatcgtgccgctggtgatgttcatcgtgattgccgcggtggcgttcaaggcggacatcttcacccgcgacatctggggccgtgccaacccgaacttcggcggggtgatggaccaggtgcgcaatatgatgctggtcacggtcttcgtgttcatcggcatcgaaggcgccagcgtctattcggcccgggccgagaagcgtgcggacgtcggccgggccacggtaatcggctttatcggcgtgctggccctgctggtgctggtcaacgtgctgtccctggggatcatgagccagccggaactggcgaccttgcagaacccgtctctggcggcggtgctggagcacatcgtcggtccctggggcgcgttgctgatcagcatcggcctggcggtttccctgctcggtgccttgctgtcgtgggcgctgctgtgtgccgagatcctgttcgccacggcccgcgaccggaccatgccggccttcctgaaaaaggaaaacgccaaccatgtgccggtcaacgccctgtggctgaccaacagcatgatccaggtgttcctgctgattaccctgttctccgccgggacctacaccagcctgatctacctcgcctcgtcgatgatcctggtgccttacctgtggtcggcggcctatgcggtgttgctcagcggccgtggcgaaacctacgagcaggcctcggccgagcgcatgaaagacctgtgcatcggtggcgtggccctgtgttacgcggtctggctgttgtacgccggcggggtcaagtacctgctgctgtcggccttgctgtatgcccccggggtgatcctgttcgccaaggccaagcgcgagcagggcgagccgttgttcaccggcatcgagaagggcattttcgcttgcgtggtcgccggggccaccctggccgcctatggcctgtacagcggagtactgtcgctgtgaggctggtttaccagcggccctatgactggccggcgatgctggcctttctccgggggcgggccatcgaggggctggagaccgtcagtggcgaccgctactcgcgcagcatcagcctcgatggcgtacacggctggttcagtgtgagcccgggcgacagcgatgcgctggcgctgaccctgcactttcccgacccgcaggcccacgcgcggatcgttgcgcgcatccgccgcctgctggatctggacaccgacctggcgccgatccatcggcaactgtccgccgacccgttgatggcccgtttgatcgcctcgcggccggggctgcgcgtacccggtgcctgggacggtttcgagctggcggtacgcgcggtgctggggcagcagatcacggtggtggcggccatccgcctggcgggcaagttggtggcgcagtatggccagccattgagctgcagggcggcgccagcggggttgagccatgtgttccccgagccggggcggatggcgggcgccgatctggcgagcctgggcatgccgcgcagtcggggccgaaccctgtccggcgtggcgcaggcgctgctcgacgatccgcagctgtttgcccccaaggccagcctcgaacacagcctgtcggccttgcgggcgctgtggggtgtcggcgactggaccgcgcattacgtggccctgcgccagttccgcgaagcggacgcctttcccgcggcggacgtgggcctgctcaacgccctggcggcgctcgaaggcggaccggtcagcgccagccagttgctggcccgcgccgaggcctggcggccatggcgcggctacgcggcgcagcatttgtggacggcgttgtagccccctgattcccgtttctgtagccgctgccgagcctgcgaggctgcgctcgaggacgcagtcctcgccaaccctgagcacgcgatatgaatgacgtaacgcgcggcctgattgacgtccgctttgcggccgatcgcagcctcgcaggctcggcagcggctacagggttacgcgttacaggctcaccatttcgggcgatgggcgcccaggtcgctggcggggtgcgtccattgcaggggcgtgccgctgatctgcaagggcacttgcaggcgatgggccgggccccagggtgtctgctctaccagcaggccctgatcgtcctggtcctcgccgcgcaaggcgggctcggcgctgccattggagtgctcgatcaacagcttggcggtccgcgccagtgacagccgtgcgcctgcggcggccccggtttgcagtcgttcggtcagggcgcggatcgcggcggcggccatcaggtagccggtggcatggtccagggcctgcaccggcagcggtaccggtttatccgcctgctgccagcgctggccggcctcggcaatgccgctgctcatctgcaccaggctgtcgaagccacggcggttctgccaggggccgctccagccataggcgttcaggcacacatcgatcagccccggggcgaagcgctggcgttcggcggccccgtagccgaggcgttccagggcatcggcgcggtagccgtgcagcagcagatcggcttcccccaacaggccttcgaagacctggcgatcggcggcatcgtgcaggttcagccgggcgcagcgtttgcccagggtgacttcagggaccacgccgggttcgttccagtccggcgggtcgatgcgcaatacctcggcgcccagcccggcgagaaaacggctggcgatgggcccggccagcacccgggtcaggtccagcaccttgatcccggccaggggccggaccgacgatccgcaccagggctgggcggtgcaggcgttgcgggtctggtaatgcaccaggggctcggcattcacggcctgcccctgggcgtgggcttgccactcggcccagctgcgcatttcggcggcgcagccacctgcctcgaccaccgcctgctccaggtcgctcttgttccactgcgcgaccttggcggccatggccggacgatccgcgacccggccgagcacctgttcggccgcccgccgatgatgcggcgcgttggtgtgcaggcgaatccagccgtcctgggtgacgtagtcgccggcgaccgggtcccacagcggcggcacgctccagcccagcgggcgcagggaggtggcgaaccagaaggaggccaggcgcgggtcgacgctcagggtgggcaggcgcccggtctggctgagcagcagctcggccgccgcctggccggccgcggcgatgctggcgctggccagttcggtcacggcgaaggccgagggcagggcgccgctcgaggtcatggcaatcggggtacgaggcaagcctagcgcggcttgaacagacgacagcacatcggtcattgcaggccctccgcaagagagggggcagcatagatcaaaagtgtgaagcgccgcagtcccgtaacggcgcaagacctacctgtaggagcgagcttgctcgcgatgctcttcaacgatgacgtgtaatcactggctcaacgcggcgctctctggttcatcgcgagcaagcttggctcctacaggggcaaggtcaaacgcggaactggtccatcagcttcatctgctgggtggtcagggcgttgagctggctgctgacctgggccgattcggtggcctgttcggtgagggattcggtcacgctgcggatcgccgaaacgttgcggttgacctcttcggccaccgcgctctgctgttcggcggcgctggcgatctgcaggttcatgtcgctgatcaccgtgaccgcgtcgctgatcttgcccagggcctgcaccgcttgctggatctgcccggcgttgctctgggcttgggcctggctcgaatgcatggtcgccaccacgccccgggtgccgctctggatgcgctcgatcaccaggcggatctcttccaccgagtcctgggtgcgcttggccaggttgcgcacctcgtcggcgaccacggcaaagccgcggccgctttccccggcgcgcgccgcttcgatggcggcgttgagggccagcaggttggtctgctcggcaatgctgcggatcacctccagcaccgaaccgatctgttcgctgttgaccgccagggcctcgacctcgaccaccgccttgctcacctcctcggccagggtgctgatgtcgcgggtgctgcgctcgatgatagtcatgccgtccttggccgactggtcggcgccacgggcggcattggcggcgttcgaggcactgttggcgacgtcgtgggcggtggcgctcatttcgttggaggcggtggccacctggtcgatttcgcggaactgcacctgcatgccttcgctggtctggcgggcgatctccgaggactggtcggcggtgccgcgggcgtcggtgatgctctgcttgatctgcgcgatggtcggttgcagcttgtcgaggaagcggttgaaccagcccacgagctcgcccagttcgtcttgcttgccgtacttcaggcgctgggtcaggtcgccgtcgccgctggcgatttccttgagcatctgcgccacgctgttgatcggccgggtcacgccggaggcggtcagccagatcagcagcagcccgatcacgccggcgaccgccgccaccagcagcgacaccagggtgccctgggcctgggcgtcgtcgagcacgccctggagtttcacggtgtcggccagcagcacctgctccggcaggtcgatcaccacgccccaggggcgggcgtcggcgatcgggctgaccggatacacggcgcggatcaggtcgccctgcttgaggattttcggggtattgccggccagcagttgcaggacatccctgccttcggcgccgagggtatcggcgatgcctttgccgaccttggccgcatcgttgctgtaggccgcgaggatgccgctgccggcgacgatcagcatgtgcccggcgccgtcgaacaatccgcgctgggagtcggcggccgcggcctgcagggcatccagggcgatgtccacgccgaccacgcctatgactttgccgtcgacgatcagcggcagggaaatggtggtcatcagcatcagcttgccgcccacggtgtcggcgtacgggtccagcaggcaggtgcgcttgctgtcgcgcgggcaggtgtaccagctgttatagggggtgccgctgacgctcagggtggtcttgttcatgtcctcttcgaccatcaccgtgttcagcccggtgccgccggcacggctccagtaactggcgaagcgcccggcttcgttggaggcgtggccggcgtcgttggcgaactcgctgtccttgccgtcgagggcgttgggctcgtaggcgagccagatgcccagcaccttggtgttgcgttcgaaggcggttttcaggctgtggttgagctcttcacgcagcgccgcggcgtccagcgaacgcttgccggccatggcccgcaggtcgttgatctggtcggccagggtggtgatcaccagcaggctctcgccaaaggttttctgtacccgcaccgcctgctcggcggcccgggcctgcagcaggttctgcacgctgtcggtgagcattcgcgagctggagctgctgaccaactgatcgttctggttggtctggtagatgttcatcccgacgatcaggcccaccacgccgagcaggcagagtccggacaacagcacgattttcaggcgaatggacagagagtcgaacatggggcgatctcgcgaatggatagggggtgagcggtgagtcggatgactccggtcgccaagtccattcagcgccatgcccggaacatcggcttgggcggtatttgtctgagaaaaagccgacgagcggtcatgtgtttgacataaacgaggaggagggaagatttcgctggagggcatgtcgcgagcagccgaacgtcgaccggctgctcttgcagaggaatcaagaggcctgggccagagcctccgggcgcgaccagatccacaggttgcccaggcccatgccggccagcgccaggtacagggtccagtgatggttgagcaggctcagcatcagaccggcgcacagcagcatgctgacggtggcgctgaccttggcccggcggctgatgatccggccgttgcgccagttgctcaggatggggccgaacaggcgatggttttccatccaggcgctcaggcgtggcgagctcttggtcgcggcccaggcggcgaggagcacgaactcggtggtcggcaggccggggacgacgatggcgatcaggccgatggccaggctgatgtaagccagacagccgaagaacaggcgggaggccttggacggggatcgggttgtgccggtcatgggttcgatgatgaggtgacgagcatggggctcaatccacaaggggtgggaaaaacggctgacgccagcgggttcgttcctgcagcgggcgtgagtctacgccttcaatacaggaacgagggggccggcgaaaaaatcaggccagttcaggcgccgtgtcgtaggccttttccagcagcacggtaaagcggttgaaggcatccagcgcgcctttttccgccgcggcttcctcttcggcactgaacgccaggccgtcgagggtgcgggtgaaggttttccagccttcggcgcgaccgccggccggctcgcccaggtgccgggcaccgaaggtttcgccgaggcccaggcccaccgcgcgcttgatcaggaacgccgcgccgagcttggagccctcggagacgaacagccagcccagggcttcggccttgctcgggttctgcaccgcgcccgccaccggggccgggacttcggtgtccaggtccgccaggtcggccttggccgcttcggcgcggcaacgttctgccaggtccgggacgatggcgatcagcgccgggtcgttgtacagggcgaccagttcggactggaacagatactgggcaacgacgaaacgggcgaagctactggcgctttcgaacggcgcgtgggccttgaccagggcgtcgagcctggcatggggttcgtgggtgatctggttcaggcgctgggagcgcaggctcgggcgctgtggggaatcctgggtggtcatgacaatgtccttggtcaatggaaatgagagctgcttaaaaataagagcggcttgaaatgagaagcacttgctaactagacgaacaagaagacgcggcacagtaaaaaatcctcactgcgccccctcgaaaagcgcagtgaggcagaccggatcagatgtcccagatcaggttgaccgcgaagttgcgacccggctgggtcaggcggtcgaggttggccgggctgagcacggcggcttcgccgacgctgtcgtagccgcgcacgtcatcccacagccagtacttcttgtcggccaggttgtagatgccggcgctgacggtgacgtcgtcgctgaccttatagaagccggtcaggtcgagcacgccgtagcccggggtcttgaactggctgctggtgccgtccggggtcttgaagctgctgctgtcgacgcggtctttcttcttcaccagggtccagctgagcagggcgccgtagttatcctggtcgtagcccaggccgaacacgccggtcagcgggttgaccgcgttcaagggttcgccggtgtcgttgttgcgaccgtaggcataggccaccgaaccctgggtgtacaggccctgcggcgcgcccagggcgtcgaggttgagccggcctttgacttccacgcccttgatggtggcgtgcttgatgttgttgctctggaacgtcagttcgtcgtagcccggggtcaccgcgtcttcgttgatgaagtcgcggtacttgttatagaacaccgccacgtcgaaattgccggactcgaagttgccgcgcaggccggtttcatagctctggcttttctccggcttgaggttcgagttcggcgccacgcggtaaccggtggtggtgttctcgaagcggccgtacagcgccttggcggtcggggtgcggaaaccttcggcgtactggccgtaccaggtgtactggtcgctcagggcgtaggtcaggccgaacttgggcgatacccggtgccaggtcttgttctggtcgctcacttcaccattgccatcggcggccacggtgttgaggaactcctgggtgatgtgcggcttgagctgggtgtagtcgtagcgcaggcccggcaggaaggtccactggttccagctgatctggtcctgggcgaacaggctgtaggtgttgatggtcgggtcggggaagtcgctggacttcttcagcacgtcggacgggctgatggcgccgaccgccgtgcaaccgcgaccgaccgccaggcaggtgccgctgccgctgcgcgagccggtgaccttttcctgcttgatcgtggtgccgtaggtcagcaggtgctcggtttcaccgatggcgaaggccttgtcggcctgggcgtcgaagacccactgcttttcctggtagagggtttcgcggctgcgcatgacgttgcggctgaacgggaagtagttttccagggtgctctggtcggtcttggcgatctggtagttcaggctccacttcacgtggtcggccagcaggctgtcgggggcgaagttgttgtccaggccgaagcgttcgcgggtgatggtgtcgttaccggtgcgcgagcggtacatgcccagcggctggccggcgttgaacgggccgcccacggcgctcttctggttggtgtcgcggtcgtccttgtacttctcgtaggtcaggcccaggcgcgcgtcgtcggcatagttccagccggccttggccagcacgttgctggtgcgcacgtcttccgggttggcggcggtgcgcgccaggccggtgccgttgtggctgccgtaggagtcggtttcgtggccgtcgcgctggctgaagtgcagcaggccgtcgaactgaccactgcgtccagccacggtggcggatttcagccagctgtcgtcggccgagctgtagccggtcttcaggcgggcgccgacgtcctggcctggcttgatgatgtcgtccgggtcgagggtgaagtagctgaccgcgccgccgatggcgttgctgccgtacagcaccgaggccgggccacggaggatctccacgcgcttgatgatttccgggtcgacgtaattattgcgctgggtcttggcataggggccgttgaagaagccgttgggaatctccacgccgtcgacctgggtcaggatgcggtcgccgtcgatgccgcggatgttgtagccgctgatgccgccgccgcgctggccggcgccgccgaccgaaacgcccggctcgtagcgcaccaggtccttgatggtgttgacgttgttgcggtccaggtcctggcggtcatgcacggtcacggtgctgggcacgctgctgacctcctgttcctggcgcgtggcgctgatggtcacctgttgcaggttcagggcaccgccgctggcgcgtttttccaggacgatgttgttggcgcccagcttgcggtagctcaggttggtgcccatcagcaggcggtccagggctttttccggtggcagcgaaccgcgcacgcccggggatgcgatgccttcgcccagttccgccggcaggccgacctgccagccggtgacggcggtaaaggcgttcagcgccgacaccagcggctgctggtcgatggcgaagctgtagtcgcccatgttgcgcgctggcagggccttggccccggcggtggcggccatgactggcgcggccccggccagcaggatggcggcggtcagcagggacagcgtgcagttctgcaggcgggcctggcgggaggatgaagaggaccggctgttgaggcgagaggacatcgatagcgctccgtgtcgcacgaatctttataggtgctgactcgcatgattaatgcgaatcaattgcattggctataacgagacgaacgaccgacagcgatcgcgtaaaaataaatgcgtgctagttgagaatcaccagcgcagggaactcctgcagccgcgccgaggtgatgtgagccagggaacgcaccacgtccagcggctggtcgaggcggtaattgccggtgaccgcgacatcggccaggcgctcgttgttgttgacgatccagcccgggtaataccgacgcaattcggccagcacctggttcagcgggcagttctcgaacaccagccggccctggacccaggccaggtccttgtcgaggtcgagcttggccgggcggtcgaaaccgttggggccgatgcggatgctttcgccggccgacaggcgcacccgggcatcgtcgtgggtggcgcgcaggtcgacatcgccgcgctgcacccgcacctgggccacgccgtccaggtaacgcacggcgaaggcggtgtcgcgcacgctggcgcgtaccgggccggcatcgagttccagtggctggccgcggctggcggggatctcgaagaaggcttcgccctggtacaggcgggccacgcgctggcgctcgtcgatgctgctggagaaggccgaattggtgttgagcaggactttcgagccgtcctccagttgcaggcgctggcgctcgccgaccacggtcaggtggtcggcctgcaggcgcaggggcaggttgctgaaactgaacaaaccgaggatcagcaccgccgcggtcgccaggggccgccagtgcggacgcaggcgcgacagcacactgagcttgggtttttgcgtgtccaggttttgcgcgcagcgcaccacctgcgggccgttccagatcacctgggccttgtcgaaggctgcgctgtgcaggggcgaggcgttcaaccagtcatggaattgccgggtctgctcggggctcgggttctccagcaggatcagccagtccagggcctggtccatggcttgatccgcggcgcaggggggggatgtttcctcgtcctgggcggtcggctgggtgcggtggatgtccgtcacgggtgttcctcggctgtgtctgtgcacggctgttttttagatggagagcgcagggcggtcaagggtagcaaagggctgcggctgacgcccgtccggctgggcctcaatgaccgttcaagcgctcggcgacgccgatgcagatggccatgatcagcttcagttccttttgcacggtgctctgggagacctcgagcttctcggcgatctccaggtagctgtggccgtgcaggcggctgaggatgaagatccgctgttggcgcgggctgagttgggcaaggctcatgttcaggcgttccagcaactgttcggcatgggcggcatcctcggcgctgctcaggggcgcggccacgctttcgaccacgtccaccggcacgtcttcgagcagggtgcgggcctggatgcgtcgcgcgcgcaggtggtcgagcgccaggttgcgggcggtctggaagacgaagggttcgaggtgctcgatggcccgttcgctcagggcccgggtcacccgcaggtaggtttcctgcagcaggtcctcggcggtgctgtggttgttgaccatccgctccagcgtgcgcagcagcgaaacgcgctgggtgagaaagacgtgattgaagcgggattggctcacaacaggacctggctgattttttcagcagatgataatgcttatcatctacgtcgaaggtcaagccctgagtgaatcatcgacgcccggagaggtaggccgggtagtccggaatccggtagctgtgcgcctgctccatcaacgggctgctgagcaggtagtcggcgctgcattcgttgcaggccacgggaatgttccagaccgccgcgacccgtagcagggccttgatgtccggatcgtggggctggggttcgaaggggtcccagaagaacaccagcatatccacccgctgctcggcgatccgcgcgccgagttgctggtcgccgcccagggggccgctgatcatgctttccaccggcaggcccaggcgctggtgcagcaactggccggtggtgccggtggccagcagatcgtgctcggcgagccggtctttctgccgctcggcccagtcgaggaggaaactcttgcaatggtcgtgggccaccagggcgatgcgcttgcgcgccgccatgctggcctgggtgaagctgataccgatcatcggtggtggctccgggagggagagagtctgcaggagctgccgaggctgcgatctttgcgcgcttgaacctcgaatgtgaagatcaaaagatcgcagcctgcggcagctcccgcgccgcaggccgtgggtttactcggcgctgcacagggccaggcagttatccagcatgcggttggagaagccccactcgttgtcgtaccaggccaggaccttgagcagcttgccgccgctgaccttggtgtgattggcgtcgaagatcgacgacagcgggttgtggttgaagtcgctggagaccagcggcaggctgttgtagccgaggatcttcgagtgctggctggcactcttgagcagggcgttgacctcctcggcggtggtgttgcgcttgagctgcacggtcaggtccaccagcgatacgttgatcaccgggacgcgcaccgccatgccggtcagcttgcccgccagttccggcagcaccaggcccacggcttcggccgcgccggtcttgctcgggatcatgttctgggtggccgaacgggcgcggtacggatcgctgtggtagacgtcggtcaggttctggtcgttggtgtaggcgtggatggtggtcatcagcccgctttcgatgcccagctcgcggttcagcacctgggccactggcgccaggcagttggtggtgcacgaagcattggaaatgatctggtgcgactggcgcagaatatcgtggttcacgccatacaccacggtggcgtcggcgcctttggccggggcggaaataatcactttgcgggcgccggcgctgatatgggcggcggccttggcacggtcggtgaacagaccggtgcattcgaataccacgtcgatcttctcggcggcccagggcagttcggccggattgcggatggcgctgacggcgatccggtcgccgttgacggtcaggctttcctgatcgtgctgcacctcggcatcgaaggtgccgtgaacggtgtcgtatttgagcaggtgggcattgatcgaactatcacccagatcgttgatggcgacgatctgcagatcctgacgatagccttgggtataaagtgcgcgcaggacgttgcggccgatacggccaaaaccattgattgcgattcgtagagtcattagaaaagcgcctgccgtagttttgttgttggaattacaagattattcgcaaaaaaatagaaaacaagcctttttggtggcaatattttgttttatctacaacgagtgacctgaatcaactggtccaaatggtcaagaaaccctctgccatcccctgtgccgcgggcgttttgaccagcatagacaaacaggtcgccacatccgttagcctggagttctacacatgcatccccgcgttcttgaggtcaccgaacggcttgtcgcccgcagtcgcgccactcgcgaggcttacctcgccctgatccgcggcgccgccagcgatggcccgcaacggggcaagctgcagtgtgcgaacttcgcccacggcgttgccggctgcggctcggaagacaagcacagcctgcgcatgatgaatgccgccaacgtggcgattgtttcgtcatataacgacatgctctcggcgcaccagccgtacgagcactttcccgaacagatcaagaaggccctgcgcgagatgggttcggtcggccagttcgccggcggcacgcccgccatgtgcgatggcgtgacccagggcgaggccggcatggaactgagcctgccgagccgcgaggtgatcgcgctgtccaccgcggtggccttgtcccacaacatgttcgacgccgcgctgatgctcggcatctgcgacaagatcgtcccgggcctgatgatgggcgcgttgcgcttcggccacctgccgaccatcttcgtcccgggcgggccgatgccgtcgggcatttccaacaaggaaaaggccgacgtgcgccagcgttacgccgagggcaaggcgacccgcgaagagctgctggaatcggagatgaagtcctaccacagcccgggcacctgcaccttctacggcaccgccaacactaaccagttgctgatggaagtcatgggcctgcacttgccgggcgcgtccttcgtcaacccctacacgcctctgcgcgacgccctgacccatgaggcggcgcagcaggtcacccgcctgaccaagcagagcggcaacttcacgccgatcggcgagatcgtcgacgagcgttcgctggtcaactccatcgttgccctgcacgccaccggcggttcgaccaaccacaccctgcacatgccggcgatcgcccaggccgcgggcatccagctgacctggcaggacatggccgacctctccgaggtggtgccgaccctgtcccacgtctatccgaacggcaaggccgacatcaaccacttccaggccgcgggcggcatggcgttcctgatccgcgaactgctggaagccggcctgctccacgaagacgtcaacaccgtggccggccgtggcctgagccgctacacccaggaacccttcctggacaacggcaagctggtgtggcgcgacggcccgatcgaaagcctcgacgaaaacatcctgcgcccggtggcccgcgcgttctcgccggaaggcggcctgcgggtgatggaaggcaacctcggtcgcggggtgatgaaagtctccgccgtggcgttgcagcaccagatcgtcgaagcgccggcggtggtgttccaggaccagcaggacttggccgatgcgttcaaggccggcgagctggaaaaagacttcgtggcggtgatgcgcttccagggcccgcgttccaacggcatgccggaactgcacaagatgacgccgttcctcggcgtgttgcaggaccgcggcttcaaggtcgcactggtcaccgacgggcgcatgtccggggcctcgggcaagatcccggcggcgatccacgtcagcccggaagcccaggtcggcggcgcgctggcgcgagtacgcgacggcgacatcattcgcgtggatggcgtaaagggcacgctggagcttaaggtagacgccgacgaattcgccgcccgcgagccggccaagggcctgctgggcaacaacgtcggcagcggccgcgaattgttcggtttcatgcgcatggccttcagctcggcggagcagggcgccagcgcctttacctctgccctggagaaccttaagtgaagttagcgctggtcggtgacattggtggaaccaatgcgcgttttgcgttgtggaaagaccagcgcctggagtcgatccaggtgctggcgacggcggaccacgccagcccggaagaagccatcggcgtctacctgggcggcctcggcctggcgccgggtgcgatcggcgcggtgtgcctgtcggtggccggcccggtcggcggcgacgaatttcgttttaccaacaaccattggcgcctgagccgcaaggccttctgtcagaccttgcaggtcgacgaactgctgctggtcaatgacttctcggccatggccctgggcatgacccgcctgcagcccggcgagttccgggtggtttgcgaaggcaccgccgagccgctgcgcccggcggtggtgatcgggccgggcaccggcctgggcgtcggcaccttgctggatctgggcgaaggccgctgggccgccttgccgggcgagggcgggcatgtcgacctgccgttgagcagcccgcgggaaacccagttgtggcagcacatctacagcgagatcggccacgtcagcgccgagaccgcgctcagcggcggcggcttgccccgggtgtaccgggcgatctgcgcggtggacgggcacgagccgctgctcgacaccccggaagccatcaccgccgcgggcctggctggcgaccccatcgccctggaagtgctcgagcagttctgctgctggctgggccgggtggcgggcaacaacgtgctgaccacgggtgggcgcggtggcgtgtacatcgtcggcggggtgatcccgcggttcgccgactttttcgtcgaaagcggttttgcccgttgttttgccgacaagggctgcatgagcgattacttcaagggcatcccggtgtggctggtgacggcgccgtattcgggcctgaccggtgcgggggtggcgctggagcaggcgttcgcctgatccagttctacctctgtagccgctgccgagcctgcgaggctgcgataaggccgaaggccttcagcgatctttaaatccccgcgcccgcttcgtcggaatgccgcccaggtcgatcgcagtctcgcgggctcggcagcgcctacagagccttggtatctacgttttgttgatcggtaaggcataatccggccccattcataacaacaaaggacggcccgcgtgagttcagtcagtaagtcgatcttgttggttgatgacgatcaggaaatacgcgagctgctggagacctacctcagtcgcgccggcttccaggtccgcagcacgcccaacggcgccggttttcgccaggcgctgaacgaggcgccgagcgacctggtgattctcgacgtgatgctgccggacgaagacggcttcagcctgtgccgctggattcgccagcatccgcgggtcggccaggtgccgatcatcatgctcaccgccagctccgacgaagccgaccgggtgatcggcctggagctgggtgccgacgattacctgggcaagcccttcagcccccgggaattgcaggcgcggatcaaggccctgttgcgccgtgcgcagtttggccaggagcgcgccggtggcgaggtgctgtgcttcgacgaatggcgcctggacatggtcagccaccggctgttccacaacgacggcgaggaagtgatcctctccggcgccgacttcgccctgctcaagctgttcctcgaccacccccaggaaatcctcgaccgcgacaccatcggcaatgccacccgcggccgtgagctgatgcccctggaccgcatcgtcgacatggcggtcagccgcctgcgccaacgcctgcgcgacaccgagaagccaccgcggctgatccgcaccgtgcgcggcagcggttaccagttggcagccaatgtggttgccggcaatgctcactgagtggccgcgcaagctgctggcgcgggtgccggtgccgcgttcgctgctgggccggatgttgctgctgacgctgctggcggtgttgttcgcccagaccttgtccagcgtgatctgggtgtcgcaattgcgcgccacccagctcgaaggcctggtcaccagcgcccgcagcctggcccattcgatgaccgccagcgtcagctactttcgctcactgccggtggcataccggccgctggtgctcgaccagttgcgcagcatgggcggtacccgttttgtcgtgaccctcaacgacaagccgctgggcatggaggtgctaccgatcacgccgcgcaagcaggcggtgctcaaggcggtggacgaagtgctgcgccaatccctgggcaacgacgcctacatctcggtgaccttcgtcagccccgaggacctgcggattttcaacggcggcctgaaactcgatgagttgccgcgttcctgggcccactacgccctgaccctggagccggtgaacccgccggtgctggtcacgcagatccagatggcgccgggggagtggctgtacatcgcctcgctgttgcccgagccctacaccagcctcgaagaacaggggctgccggcgcagcaggtgtggttcatcgtgctcaccagcggtttcctgctgctgttcatcggcctgctggtgcattggcagagccggccgctcaagcgcctggcgcgggccgctcgggacatgtccctgggcgccgatgtgcagccggtggccgaaggcggcggcagcgaagtggtggaggtcggccgggccttcaatgccatgcgcgagcgcatcagccgctacctgaccgaacgcagccagttgttcagtgcgatttcccacgacctgcgcacgcccatcacccggctgcggctgcgggtcgaactgctggaggacgagcagttgcaaaccaagttcggtcgcgacctggatgagctggagttgctggtcaagggcgcgctgcaatgcgtcaaggacaccgatatccacgagaacatcgagccggtggacctcaaccaggtgctcgactgcctggtggagccttacctggcgcccaacggcaacggccgcgtgacccagcaggggcgggcgctggcgccttatccgggcaagcccctggcgctcaagcgctgcatgggcaacctgatcgacaacgcgctgaagtatgggcagaacgcccacctgcacatcgacgacgatgccaatgcgttcatcctgcatgtcgacgacgaaggcccgggcgtgccggagcagcgcctggagcaggtgttcgagccgcattttcgcctgtccggccagcagcagggctacggcctgggcctgggcatcgcgcgcaacatcgcccatagccatggcggcgaggtgagcctgcagaacctgcgcgaaggcggtttgcgcgtgaccctgtacctgccgcgctccatggattgatgcccttgtagccgctggcaaagcctgcgcccggccgcgtagcggtcgtaaaacgttatgccgcgcctggtcgtatgaccgaggtgccggttttgcgcgccctgcggtctcgagcgcagcctgcggcagcggctacaggggttttgtcacggtttggtgacatttcctgtgaccttcgttacctgcccgcgcgaacccgttgtttagactcaaggccctgataagaacaacaacaggttcgccatgaacactattccactgacgttcagcagttggctgaacgctcctgcccatcatcaatggctggccgccgaaggccagcgcctgctggggttcgcccgcgcggcacggctgcccgaaggcttcggcgacctggacgagcgcgggcgcctgccgagcgatgcccgggccggcaccatgaacaccgcgcgcatgacccacagtttcgccatggcccatatccagggcattcccggttatgccgcgctggtggaccacggcatcgccgcgctcaacggtgcgctgcgcgatggcgagtacggcggctggttcgccagccccggacaggccgacggcaacagtggcaaggccgcctacctgcatgccttcgtcgccctggcggcgagttccgcggtggtggccgcacgccccggcgccgaagccttgctggcggaggcgatcggggtcatcgaaatgcatttctggagcgaggaggagggcgcgatgcgcgagtccttcaaccgcgactggagcggcgaggaggcctatcgcggcgccaacagcaacatgcacgccaccgaggcgttcctcgccctggccgatgtcacccaggacccgcgctggctcaaccgtgccctgcacattgtcgagcgggtcatccatgagcatgccgccgccggcgattaccgggtcatcgagcatttcgaccggcagtggcagccgctgccggattacaaccaggaacatccggccgacggtttccgcccctatggcaccacccccgggcacgccttcgagtgggcccgcctgctgctgcacctggaagccgcgcgctgccaggccggcatgctcagccccggctggctgctgctggatgcccagaaactcttcgagaatgcctgccgtgacgcctgggacgtcgatggcgcgccgggcatcgtctacaccctggactggcagcagcgccccgtggtgcgccagcgcctgcactggacccacgccgaagccgcggcggcggccagcgccttgctgcaacgcaccggggaagcgcggtacgaaacctggtatcggcgcttctgggagttcactgccgagcatttcatcgacccgctgcacggcagctggcatcacgagctggacagcaacaacaggcccagcgccgagatctgggccggcaagccggacctgtatcacgcctggcaggcagtgctgattccgcgcctgcccctggcaccgagcatggcatcggccttggccgaagtgtctagactgcaggttgtgtaaccatgtagtgacattcgcgcatcccttcgttacctgcgcgggtggggcccctgtttagaatcctatgcagcgcaagcaccagacttgcatgcataacaacaagaaaggtacacctcagatgaatgcgatttctcgtctagctgctgtcatttccgttgcctcgttgtttcccctcagtgcattccctctcgtttccgttgccgccgatgccaaaggttccgtggaagtcgtccattggtggacttccggcggtgaaaaagcggcggtcgatgtgctcaaggcccaggtcgaaaaagacggtttcacctggaaagacggcgcagtcgccggcggtggcggtgccacggccatgaccgtgctgaaaagccgcgccgtttccggcaacccgccgggcgttgcccagatcaagggcccggacatccaggagtggggcagcaccggcctgctcagcaccgacgcgctgaaagacgtggccaagtcggaaaactgggacggcctgctttccaagaaagtctccgacaccgtgaagtacgaaggtgactatgtcgccgtgccggtgaacatccaccgcgtcaactggctgtggatcaacccggaagtcttcaagaaggccgggatcgacaaggccccgaccaccctcgaagaattctatgccgccggcgacaagctcaaggccgccggcttcatcgccctggcccacggcggccagccatggcaggacagcaccgtgttcgaagacgtggtgctctcggtcatgggcgccgatggctacaagaaagccctggtcgacctggaccagaaaaccctcgccggcccggagatgaccaaggccttcaccgagctgaagaaagtcaccggctacatggacccgaaccgcgccgggcgtgactggaacatcgccgccgccgacgtcatcaacggcaaggccggcatgcagatgatgggcgactgggccaagagcgagtggaccgcggcgaagaaagtcgccggcaaggactaccagtgcgtggccttcccgggcaccgacaaagccttcacctacaacatcgactccctggcggtgttcaagctcaaggccgatcgcaaaggcgatatcgccgcgcagcaggacctggccaaggtcgccctgggcaaggacttccagaaggtcttcagcatcaacaagggttcgatcccggtgcgcaccgacatgctcaacgacatggccgcgcaaggtttcgactcctgcgcccaggcggcggccaaggacttcctggctgacgacaagaccggcggcctgcaaccgagcatggcgcacaacatggccacctccctggccgtgcagggcgcgatcttcgatgtggtgaccaacttcatgaacgacaaggacgcggacccggccaaggccagtgcgcagctggcgtcggcggtcaaggctgctcagtaactccgaatgccgcaggcctgcctgcggcgatttatctgacggctctttcccctgtaggagcaagcttgctcgcgatgactgcatgacattcgacagaggtgtcggcagtcggatcgctatcgcgagcaagctcgctcctacagggggcgtgtcggacctcacttcttcaattggattatcccgatgagctctgtggcggttttcagcaaagcctcaccgttcgacgcgctgcagcgctggctccccaagttggtcctggcgccaagcatgctgatcgtcctggtcggtttttacggttacatcatctggacgttcattctgtccttcaccaattccagcttcatgccgagctacaagtgggtcggcctgcagcaatacatgcgcctgatggacaacgaccgctggtgggtggcgagcaagaacctggcgctgttcggcggcatgttcatcggcatcagccttgtgttgggcgtgttcctggcggtgctgctagaccagcgcatccgcaaggaaggctttatccgcaccgtctacctgtacccgatggcgctgtcgatgatcgtcaccggtaccgcctggaagtggctgctcaaccccggcctgggcctggacaagatgctgcgtgactggggctgggaaggctttcgcctggactggctggtggatcaggatcgcgtggtgtactgcctggtgatcgccgccgtgtggcaggcctcgggctttgtcatggcgatgttcctcgccggcttgcgcggcgtcgaccaatcgatcatccgcgccgcccaggtcgatggcgcgagcctgccgaccatttacctgaagatcgtcctgccgagcctgcgcccggtgttcttcagcgccttcatgatcctcgcgcacatcgcgatcaagagcttcgacctggtggcggcgatgaccgccggcggcccaggctactcgtccgacctgccagcgatgttcatgtattccttcaccttcagccgtgggcagatgggcataggttcggccagcgccatgctgatgctgggcgcggtgctgaccatcctggtgccgtacctgtactccgaactgcgaggcaaacgccatgactaaccagctcggaaaacctgcgctgaacttcagccgcatcgccatctacgccaccctgctgctggccgcggcggtgtacctggtaccgctggtggtgatgctgctcaccagcttcaagaccccggaagacatccgcaccggcaacctgctgagctggccggccgtgatcgacggcatcggctggatcaaggcctgggacaccgtgggcggctacttctggaactcggtgaagatcaccgtgccggcggtgatcatctcgaccttcgtcggcgccatgaacggctacgtgctgtcgatgtggcgcttccgcggttcgcagctgttcttcggcctgctgctgttcggttgcttcctgccgttccagaccgtgctgctgccggcgtccttcaccctcggcaagttcggcctggccaacaccaccagcggcctggtgctggtgcacgtggtctacgggctggcgttcaccacgttgttcttccgcaactactacgtgagcatcccggacgccctggtcaaggccgcgcgcctggacggcgcgggcttcttcaccatcttcggcaagatcctgctgccgatgtcggtgccgatcatcatggtctgcctgatctggcagttcacccagatctggaacgatttcctgttcggcgtggtgttcgccagcggcgatgcgcaaccgatcaccgtggccttgaacaacctggtcaacaccagcaccgggaccaaggaatacaacgttgatatggcggcggcgatgatcgccgggctgccgacactgctggtctacatattcgctggcaagtatttcctgcgtgggctgacgtccggcgcggtcaaggggtaaaagatggcaactctcgaattacgcaacgtcaacaagacctacggcagcggcttgccggacaccctgaagaacatcgaactgaagatcgatgacggtgagttcctgattctcgtggggccctcgggctgcggtaagtccaccctgatgaactgcatcgccggcctggaaaacatcagcggcggggcgatcctggtggacgacgccgacatcagcggcatgagcccgaaggatcgcgacatcgccatggtgttccagtcctacgcgctgtacccgaccatgagcgtgcgcgacaacatcgccttcggcctgaagatccgcaagatgccggccgccgagatcgacgaggaagtggcgcgggtggccaagctgctgcagatcgaacacctgctcagccgcaagcccggccagctgtccggcggccagcaacagcgcgtggccatgggccgggccctggcgcggcggccgaagatctacctgttcgacgaaccgctgtccaacctcgacgccaagctgcgggtcgagatgcgcaccgaaatgaaactgatgcaccagcgcctgaaaaccaccacggtctacgtcacccacgaccagatcgaagccatgaccctgggtgacaaggtggcggtgatgaaggacggcatcatccagcagttcggtaccccgaaacagatctacaacgacccggccaacctgttcgtggccagcttcatcggctcgccgccgatgaacttcatccccctgcgcctgcagcgcaaggacggccgcctgctggccctgctggacagcggccaggcccgttgcgagctgcctttgggcatgcaggacgccggcctggaagaccgtgaagtgatcctcggcatccgcccggagcagatcggcctggcgaacggcgagggcaacggcctgccaaccttgcgcgccgaggtccaggttaccgagccgaccggtcccgacaccctggtgttcgtcaacctcaacggcaccaaggtctgctgccgcctggcgccggatgtggcgccgcaggtcggtgaaaccctgaccctgcaattcgatccggccaaggttctgctgttcgatgccaagagtggcgagcgcctgggtgttgcggcccctgcgcaggccgaaacccatgccagtaacgtggcgcagttcaaggggcgttgaggcccgcgttattggagcaaagacgtaccgaatgcgcggcggatggcctgtcatccgtcgcatcaggtgtaaaccgcgttagagaaaaacagttaataacaataaagacgaggatgtagggatgaaaaagaagagcaccaatgcacgcttgatctgccagttgtcagcgattgcggcaatgaccctggccggtagcgcgcacgctgacgaagcgttcagcgccgattcgaaatggatgaccggcgactggggtggcgagcggaccaagctgctcgagaaagggatcgacatcaaggccgattacgttggcgaaatgggcgccaacctgcacggcggctacaacgacgacaagaccggacgctacagcgaccagttcggcctgggcgtagccctggacctggaaaaactctggggctgggataacacccaggcgaagatccagctgaccaaccgtaacggccagaacatctccaacgaccgtatcggcgatccgcgtgccggcaccctgagttcctcccaggaagtctacggccgtggccacatggtgcgtctgacccaactgtggatccagcaccagttcctcgacggcaagctcgacgtcaaggccggttacttcggcgaaggcgaagacttcaacaccttcccctgcgacttccagaacctggcgttctgcggctcccaggtgggcaactgggcgaccaacatctggtacaactggccagtcagccaggcggcactgcgggtgaagtaccacatcacccctgagctgtacgcgcagatcggcgcgtacaaccagaacccgtcgcaactggaacacggcaacggcttcaagctcagcggcagcggtaccaagggcaccgtcctgccggtcgagttggtctggtcgccgaaggtcaacaacctgccgggcgagtaccgcgtcggttactacaagagcacggccgatgccagcgacgtgcgcgaggacgtcaatggccaggacgccgcggtcacccgcgacagctatcgcgtgcacagcagcaagcacggctactggttcgtcgggcagcagcagctcaccacccacaacggcgatgcgacccgcggtctgaacatcgcggccaacgccacgttccacgacaaggacaccaacttcatcgacaactaccagtcgctgatgttcgtgtacaagggcccgttcgacgcacgtccgaaggatgacgtcggcatcggtttcgcccgtatccatgtcaacgacgacgtgaagaaaaacgcccagttgctcaatgacaccaacggtgtcagcaactacgacgatccgctgttctcgccgatccgcgagactgagtacaactacgaaatcaactacggcttccatgtcaccaactggctgaccgtgcgtcccaacctgcagtacatcacccatccaggcggtgtggatgaagtcgacaacgccctggtggccggcctgaaaattcagtcggtgttctaacgctgttgcgataagctcctcctctatgtgcgcatttttgcggatggccttggctatccgcttttttttggggacgaacccgttccctgtagccgctgccgcaggctgcgataaggccgcaggccttcagcgatcttgaggacgctacggccgttccggccgatcgcagcctgcggcagcggctacaggagcttgcgcagcatgatgactatcaggacagcaatgatcttcaggaccgtggcccatgcatgagcatccgctacaacgctttttcaaatccttgcgcgagcgcccgaccttcgcctgggagcgctatcagatgcgcgatgtgctggtgatcgaccatccgctgtgccaggcggtgttcagtcgccagggcgcgcagctcctgcacttccagccgaccgggcagaagccctggctgtggtgcgcggcgaagtggccgcaggtcggggcgatccgtggcggggtgccggtgtgctggccctggtacggccgtcacccgagcgaaaatgcctggccgtcccatggctgggcgcggctgatcgactggaagctgctcgacagtcgcagcgatgacgagggcgtgtacctgcactggcagttgcagctgtgcgactggcaggtcgatctgcacgcacacctgggcgaaagcctggacctgcgcctgagcaccgagcaccaggacagcctgccgtgccagctgagccaggctttgcacgcctactggcgtattggcgacgtcggtgaggtagcgctgtctgggctcgacggcgccgaaggttacgaccagttgagccgccaggtgtgccggcaacaaggcgagctacgggtcgatggcggctgccagcgggtgttccagcacgagggcgaattgcagctcaaggaccacgcctggcagcgcgaattgcgcatcgacaccggcgacaccgccgacaccgtggtctggcatccgggcagccggccgctgctgggggtgagctggaacgaggtgtccgggttcgtctgcgtcgaggccgcggcgggcggtaccgacagcctgtgcctggcgccgggggagcgggcgcatctgagcttgcaggcgcgggcgggggctgaggtcggcgttcgggcttgagggtctcatcgcgagcaagctcgctcctacaggtcaatggggtcttgtaggagcgagcttgctcgcgatagggccggtaacggccctcagttgtactcgtcgcccaccggatagcggctggcgttgaggctttccttgatcttgcgcaggtgcggctggaagtccacgccgcggcgcagggtcatgccggtggcgaggacgtcgagcacggtgagctggatgatccgcgacgtcatcggcatgtagatgtcggtgtcttccggcagcgggatgttcaggctcagggtgctggccttggccaatggcgagttggcggcggtcaggccgagtaccgaggcgccgttttcccgggcgatgcgcgccacttccaccagctcgcgggtgcgcccggtgtaggagatgatcacgaacagctcgccggtgtgggccaccgaggcgatcatccgctgcatcagcacatcggcgtgggcggtcaccgccaggttgaagcggaagaacttgtgctgggcatcgagggccaccggggccgaggcgccgaggccgaagaagtggatctgccgggcctggatcagcaggtcgacggcgcggctgatcaggttcgggtccagggcctggcaagcgctgtccagggaggcgatggcgctgccgaagattttctgggtgtaggcttcggggttgtcgtcggcttccaccgcgcggctgacgtaggccgcgccgctggccaggctctgggccagttgcagcttgagttcggggtagccgctgacgccgaacgagcggcagaaacggttgaccgtcggctcgctgaccgaagcggcctgggcgagggcagcaatactgaagcgggtcgcctgctgcgggttgagcaggatgacttcggcgactttacgttccgccttgttcaattcttcaaggcgattctggatctgttccagaagatttcgcacgcggtccattagggttttcctggttcggcaatgcaaaggaagccggtcttaaccggtctttggcggtggcctatcctactgatggctccgacggaccaccacttcgaatctgtattttgctaaaatgttgtggttattactacattttcccttgagtgatgccttgaaaaaaggtatttgtagcttaacttgataaaagaacaaacatcatgccttcgataacggttgaaccgtgcacctttgccttgttcggcgcgctgggcgatctggcgcttcgcaaattgtttcctgccctgtaccaactcgatggcgccggcctgctgcatgacgacacgcggattctggccctggcccgcgagccgggcagcgaacagcagcacctgtctttcattgaagcgcaattgcgcaagtatgtaggtgccaaggagatcgacgcggcggtgctggagcgcttcctggcgcgcctgacctacctgcacgtggacttcctcaaggccgaggattacctggccctggccgagctggccgggcgcgagcaacgcctgatcgcttatttcgccacgccggcggcggtgtacggggcgatctgcgagaacctgtcgaaggccggcctggccgaaaacacccgcgtggtgctggaaaagcccatcggttcggacctggaatcgtcgcgcaaggtcaacgacgcggtggcgcagttcttcccggagaaccgcatctatcgcatcgaccactacctgggcaaggagacggtgcagaacctgatcgccctgcgtttcgccaacagcctgttcgagacccagtggaaccagaactacatctcccacgtggaaatcaccgtggccgagaaggtcggcatcgaaggccgctggggctatttcgacaaggccggccagctgcgggacatgatccagaaccacctgctgcaactgctctgcctgatcgccatggacccgcccgccgacctctcggccgacagcatccgtgacgagaaggtcaaggtgctcaaggccctggcgccgatcagcccggaaggcctgaccacccaggtggtgcgtggccagtacatcgccgggcacagcgaaggcaaggccgtgccggggtatctggaggaagagaattccaacacccagagcgacaccgaaactttcgtcgccctgcgggccgacatccgcaactggcgctgggccggggtgccgttctacctgcgtaccggcaagcgcatgccgcagaagctgtcgcagatcgtcatccacttcaaggagccgtcgcactacatcttcgctcccgagcagcgcctgcagatcagcaacaagctgatcatccgcctgcagccggacgaaggtatctccctgcgggtgatgaccaaggaacaaggcctggacaagggcatgcaactgcgcagcggcccgttgcagctgaatttttccgatacctatcgcagcgcgcggattcccgatgcctacgagcggttgttgctggaagtgatgcgtggcaaccagaacctgtttgtccgcaaagatgaaatcgaagccgcgtggaagtggtgtgaccagctgatcgccgggtggaagaaatccggcgacgcgcccaagccgtatgcggccgggtcgtgggggccgatgagctccatcgcactgatcacgcgggacgggaggtcatggtatggcgatatctaaattgaaactgcctgcgggcgtgtacgcccacgagttccacagcccggcgctgctggccgaaggcctggcgctgaaggtggccgggcaactgagccaggcgatccaggtgcgcggcgaagccacgctggtggtgtccggcgggcgtagcccggtggcgtttttccagcacctggccaagcagcacctggactggtccaaggtgttgatcaccctggcggacgagcgctgggtcccggtcgaacatgccgacagcaacgccggcctgctcaagcgctacctgctgcaagggccggcggccaaggcgaagttcctcagcctgtacaacgctgcggcgaacctcgaacaggccgcggtgcaggccgatcgtctgctggccgagttgtcggccatcgacgtgctgatcctgggcatgggcgacgacggtcacaccgcctcgctgttccccaacagcccgaacctgaccgaagccctgcgggccgacggccagcgacgctgctggccgatgctggcgccgagcgtgccgcatcagcgcctgagcatgagccgcgccttgctggcctcggccacctacagcgtgctgtcgatttccggtcaatccaaattgaccaccctgagtgccgcactggccggtgacgatgtcgccgcgatgccgattcgtgccttcctgcaacctccgttagagatttactggtgcccatgagccaaggatcagccgctatgacaatcccacaaccgaccgtttccatggcggacaaagttgccctgatcgacagcctctgcgccaaggcgcggattctgccggtgattaccatcgcccgcgaacaggacgtgctgcccctggccgacgccctggccgccggaggcctgaccgccctggaagtgaccctgcgctcgcagttcggcctcaaggccatccagatcctgcgcgagcagcgtccggagctggtgaccggcgccggtaccgtgctcgatcgccagatgctggccgccgccgaagccgccggttcgcagttcatcgtcaccccgggcattacccgcgacctgctggaagccagcgtcgccagcccgatcccgctgttgccggggatcagcaatgcctccgggatcatggagggttacagcctgggctatcaccgcttcaagctgttcccggcggaagtcagcggcggcgtggctgcgatcaaggccctgggcggtccgttcggcgaggtgaagttctgcccgaccggcggtgtcggcccggccaatatcaagagctacatggcgttgaagaacgtgatgtgcgtcggcggtagctggatgctcgatcccgagtggatcaagaacggcgactgggcgcggatccaggagtgcacggccgaggccctggcgctgctggactgacaggtttcctgcttttttcaaagattcgttggtgtgttctacggctttacggtgcgcttggtcggtgcaccgttttttttgcctggagaaaagctgcctggcgacgccgggtcttctgtaggagcgcagcttgctcgcgatgacgccggggcgggcaacgcgatgggatgcccgttactgcctgtagccgctgccgcaggctgcgatcggccgaaaggccgtagcgctctcaggatcgcagaaggtccttcggacctgtcgcagcctgcggcagcggctacaggttactgggtcgacagttcggtcaatgcctcgaccagcatctggatatccgcgctcggcgtggtaaagcccggtgtcacccggatacagggcccgcaacgcgaaccgctgcgcgccacggtgaacaggttgtattcctggagcagccgctcggccatcgcctgctggtccggctggcgggtgaagcgaaacgaggtgatgccgcaatacagccgtggatcgtccggggtcatgacttcaatgccgggcaggttgcgcacctggctcacccacaggtcgcgcaggtaattcaggcgtgcgcccttgagggccgagccgcccatgccgcggtgttcctcgaacacccggggcaaggtcagccaggccggaatgttcggcgtgccataaggcgcccgtgagcggatgtcgtccagggcataacgttgctcgcccatgtccggatcgatatcggccaagcgttgcgggtcgatatagacaaaacccaggctcagcggcgcgccaatccacttctgcaggttatagccggcgaacgccacgcccagttcactgagctggaaatcgacctgggccagggcgtgggcgccgtcgagaatgacgtcgattccccgttcgcgggcatccagggcaatggcctggaccggcagcaccagcccggtgcggtgggtgacgtgggtcagggccatcagtttcagtcgcgggtagcgctcgaaggcctcgcgataactggcccgcaggctgtcgaagcttgccggatgagcatgctcgatctcgatgacctcgaccccgcgatggcgcgccagccagcgcatggcccccttgacgctgtcgtattccaggtcgctgagcagcacctgatcgcccggctggagacggttgtagttgcgaatcagcgattgcagcgcctccgaagcgctgcgggtgagggcgatggcctggcggtcgacgccgaccaattcggccaattgctgtcgaatctgcccattgccgatctgttcgaaatgctggcgcacatgcaccgagttgctgcggttcacgaagtcgatctggcgctggtattcctcgaccacggcgcggctcatgcgcccgaaatagccgttttccaggttgatcggcccgggttcgaggtcataccgccgggcaatggcccgccaatagtcttcgtcgcgagcgagttgggcattgcttggcatggcgggctctgttcaatgacggggtttgggtttgccgtgtttggcgcgcagcgggtccagtagatcggagaggccgttgtgatcgatttcctgcatcaaggccaacaggccgcccagctcgccgtgggggaacccttcgcgggcgaaccagttcaggtaggggccgggcaggtcggcgaggatgcggcccttgtacttgccgtagggcatttcgcgagtgaccagaagttcaagtttttcgggattcatggcggctgtctgttgaggtgacgaacaccttggaaaatacaggcattctgcatgcaggccaaatgacagatcatgcaaataacgcggatacagaaagcggtgtaaaacttaaattattgaaaaataacagtaaattttaattccaagactggcatgcagggtgcaacacctatgacaactccctcaacctggaaggaatgaaaaatgactgacatcaacaaagaagcgatttcgatcctcaacgacctgatcgaaaccagtaaggatggtcaggaggggttcaagacctgcgcagaagacatcaagcagcctgagctcaaagcgctgttcgtcaagcgctccgccgactgcgccaccgccgcggccgaattgcaggccagcgtgcgttcgttgggcggcgatccggaaacctccaccagcgtcagtggcgacctgcaccgccgttgggtcgacctcaagtccctgctgaccggcaaggacgaagaagcggtgctcaacgaggccgagcgcggcgaagaccacgccctgaaggcctacaaggatgcgctggagaaaatcagcaaacacaacctggtcggcattcgtgacctggtggagcgtcagtaccatggggtacagcgcaaccacgatcaggtcaaagccctgcgtaaccaggcccgcgcccgttcataacgggtaaaacctgtcaaaaacgccagcctgtctggcgtttttttatggcttgaaattaatactggacgactgatagttagctagctaataatttgcgggcatcatctctcgctcccgtgcatctatcgttgttttgtcctttccagggttcttttcgtgcgtatcactttgcaggcgttgttcgcccccaatcttgcggccgtgcagttcgcgatcaagaccgtgctcggcgccgggctggcgttgtggctggccatgcgctggggcctgcagcagccttcctgggccctgatgacagcgatcatcgtcgcccagccgctgtccgggatggtcctgcaaaagggcatggcgcggctggtggggactttggtgggaacctgcatgtcggtgctgttcatggggctgttcgcccagacaccgtggttgttcctgctggccctggcgctgtggctggggctgtgcaccgccagttcgaccctgctgcgcagcgcctggtcctattccttcgtactggccggctacaccgtggcgatcatcgccttgccggcgatctcccatccgttgtcgatcttcgaccaggccgtggcgcgctgcacggaaatttccctgggcattatctgcgccaccgccacgcagtgccttgctctggccgatgcgggttgagcggcagttgaccgcccaggcacgcagcgcctggcaaagcgggatgcaggcggcgcgggcgaccctggccggcgatgcccaggcgcgcaagggcctgctggaaatcctcgggcgcatcgtcgccgtggactcccagcgcgaacatgcctggttcgaaggtccgtcggggcggcagcgggcgcgggcgatcagcggcctgagccagaagctgctgatgctgctgcggatctcccgttcggtacgccggcaatggaagcaattggaccaggccgaggcgcagcagctggcgctgtggatggagcaagtacagcaagccctggcggccatggacaaaccgaccttgcaggcgttgcgaccgcagttgctggacgcttcccatgactcggcgatcagctcggcgcaaagctattgcctggcccgtttcaccctgttgctggataccgcgctggccgccggcgaggcgctgcgggcggtggaggagggcaaggcgccggtggagcagcccgccaccctgagcccccatcgcgatctgtcgctggcgctgctgtttggcgcgcgcagcgccctggctttcctcaccgtggcctgcttctggctggccaccgcctggccggcggcctccggggccatgctgctgacctgcgtggtatgcgggctgttcgccagtcgcgaaaacggcgcgcagatcggcatgagtttcatgcgtggcatcttcctggcgattccggcggccttcatggtcgggcagatcctgctgccgcagtggagcagtttcgccctgctggcgatggccatgggcgtgccgttgtttttcggcgcgctgggcatggccaaaccgcagatcggcgccacggccacctcgttctgcctgcacttcgtggtgctgatttcaccgcagaacccgatgacgttcgacgtggcgaatttcttcaacagcgcccaggcgatggtgctcggcgtaggcgccgcggtgctggcgtttcacctgctgatcctgcgcgacccggcctggcatgggcggcgcctgctggcggcgaccctgcaggacctggtgcgcttgacccggcgcaacctacgcggcgcggaaagctggttcggcgggcgcatggccgatcgcctgctgcaactggcgcggcattacccggaattgccggaacaggcgcgcagccgctgggacgatggcctgctgggcctggatatcggcgatgaactgatgcatctgcggttgagcctggcggtggcccaggtgcccgcggatgcttcgcagcgaggttatttcgagcatctggaacaggtgctggaacaagggccggccgccggtcgcggcgatgcgctggccgacgccagcacagccttgctcgaggccctgggcagccaaccgccgagcgacgcgttgaagctggcccagggcgcggtggtgcagttgcagaagagctggcgcacctggtgccggcagcaggaggaaaaccatggggctgcgtgagtgctcgctgggcggagtgttgctcagcccgtttctgatttatgtggtgctggcgctggtgctgaccggggtgttgcgcatgctgttgcgcgcaacgccactggggcgctggatctggcacgaagcactgttcgatgtggccttgtacgtctgtgtcctgacgttggtcactgtcgtactcggacctttataaggagttgttcatgcgtgcctccgtgcgtatcgcttttactttgtgcctggtggctgcggcgctgtttgccggctttcatctgtggcagtactacatgctcacgccctggacccgggatgcgcggattcgcgccgacgtggtgatagtcgcccccgatgtgtcgggctgggtgcgtgaactcaaggcctatgacaaccaggcggtgaaggccggcgacctgttgctgagcatcgaccgcgaccgcttcgaggcggcgctggaaaaggcccaggcggtggtacagacccgccagcagcaactcagcctgaaagagcacgaagccagccgccgggccagcttaggcccgcaggcgatcagcgccgagctgcgggagaacgcgcagatcaatgccggggtggcccgtggcgagctgcgccaggcccaggccgacgccaaggtcgccgaactcaacctggcgcgcagccaggtccgcgcgccgcgcagcgggcacatcaccaacctgcgcctggccgaaggcaactatgtgaacgccgggcaatcggtgatggccctgatcgacgattcgactttctacgtgcaggcctatttcgaggaaaccaaactgccgcggatcaaggtcggcgacccggtcaaggtgtggctgatgagcgctggagaagccttgcaggggcatgtggaaagcatcagccgcggcatcaccgaccgcaacaccacgccggacgggcaactgctggcggaggtggagccgaccttcaactgggtgcgcctggcgcagcggattccggtgcgcatcaggttcgacaaggtgcccgaaggcgtcaacctgagcgccgggatgacggcgagcgtgcaggtggaggaggggagtcgctaatcccgcctgtagccgctgccgagcctgcgaggctgcgccagcggctacagggcggctcagccgatattgatggccggcaaggtcggcagggtgacggtctgctgtttgcgcggggcgaggatttcggcttcgccgtccaccaccagctcatcgcgctggttgaacacgcgggtggcgatacgcacgcggaacttcggcagtttttcgaggatttccaaacgtacggtcagggtgtcgccgatcttcaccggcttctggaagctcatctgctggccgatataaatggtgcccggcccaggcagctcgcaggccaccgcggcgctgatcagcgcaccgctgaacatgccgtgggcgatacgctccttgaacatgctggcggcggcgaattcggcgtccaggtgcaccgggttgtggtcgccggacatggcggcgaacagctggatgtcacgctcttccacatgcttgctgtagctggcggtctggccgacttcgagggcttcgtacggggtgttggtaacctgggtcatctctctcaagtcctgtgctgagcgttgattggcatatcgattggaaacagggtcattcggtcttcggcggtcggcgatgccgcagggcctggtcgagccaggccagtacatcggcagtcacttcgtcgcggttgctttcattgaacaattcgtgccgcgcctgcgggtagatcgtgagctgcaggcactggctgccggcctcgcgcagagcaccggccagatccttgagacgtatgccattgctcaccggatcacattctccgccgatcaccagcaatggcaggcccggatcgatctgggccaggttggaggccttgctgatttgctgcaggccacccagcaggtcgacccacagctggttgctgcagcgaaagccacagagcgggtcgtgggcgtatttgtcgacttcgtcggggtcgcggctgagccagtcgaaggcggtgcggttgggtttgaaggctttgttgaacgagccgaaggacagccattcgatcaacgcgctgcgtcccagggggccctggcgccagcgttcgaagcgggcgatctggcgggccgcgcggtacagcgccaccggctggaaattcgagccgctgaggatcgccccgtcgaggctggcgctgtggtgcagcaggtaggcctgggcgatgtagctgcccatgctgtggcccagcagcacgatcggggtccccgggtgctgctggccgatgtgctggttgaggctggccaggtcgccgaccaccttgcaccagccgtcatcgtcggcgaagtgcccgagtgccccgtgctcggcggtcttgccgtggccgcgcaggtccagcgcatagaccccgtagccttcattgcacagcacctctgccagcctggcgtagcgcccgctgtgttcggccatgccgtggaccagcaggatcacggccttgagcggggccgccgggagccactggttgacgtagagctggctgtggtcgctcgcggtcagccagaaagagtggtggatcatggcgattcctttgcacggggtcgttgcattgtatagctcatcgtcgcggccccgtccgatctgcgcgcgccatggcggcaagattcacgttatcaatgacgcgcccggtcttatttgccctatcccccatagctgctaacgtccgcagagccccgcctttcgtagcgtgagagaagcggcccggacaactcaggtaacgaggacaagaacaatgcagcctgatttctggaatgacaaacgcccggccggagtgcccactgatatcgatctgggggcctacaagtcggtgatcgaggtgttcgagcgttcctgcaagaaattcgccgaccgaccggccttcagcaacatgggcgtgaccatgacctacgccgagctggagcgctacagcgcggcctttgccggttatctgcagagcagcaccgacctggtgccgggcgatcgtatcgcggtgcagatgcccaatgtcctgcattacccgatcgccgtgttcggcgccttgcgcgccgggctgatcgtggtcaacaccaacccgctgtacaccacccgggaaatgcgccaccagttcaaggattccggagcgcgcgcactggtgtacatgaacctgttcgggcagaaggtcgagcaagtgctgcccgagaccgatatccagttcctgatcgaggcgaagatgggcgacctgatgccgtccgccaagggctggctggtcaataccctggtcgacaaggtcaagaagatggtgccggcctatcgcttgccccaggccgtttccttcaagagcgcgctgcgcctgggccgtggccagccgatcaagcctttgaacgcccgcctggacgacgtcgccgtgctgcaatacaccggcggcaccaccgggctggccaagggggcgatgctgacccacggcaacctggtggccaacatgcagcaggcccgtgcctgccttgagcaacggggcccggatggccatccgctgttgcacgaaggccaggaggtgatgatcgcgccgttgccgctgtaccacatctatgccttcaccgcgaactgcatgtgcatgatggtcaccggcaaccacaacgtgctgatcaccaacccgcgggacatcggcggtttcatcaaggagctgaagcagtggcgcttctcggcgctgctggggctgaacacgctgttcaccgcgctgatggatcatcccgagttcaagaccctcgacttctccaatctcaagctcaccaactctgggggcacggcgctggtcaaggccaccgccgagcgttgggcgcaggtgacgggctgtcgcatcaccgaaggctacggcctgaccgaaacctcgcccgtggcctgcaccaacccttacggcgaccagtcgcgcctgggctcggtgggcttgccggtgccgggcacgacgctcaaggtcatcgacgatgagggcgtcgagcagccgctgggcgagcgcggcgaactgtgcatcaaggggccgcagatcatgaaaggctactggcagaaaccggaggccaccgaggaggtgctggatgccgagggctggttcaagtccggcgatatcgcggtgatcgacccggatggcttcgtgcgtatcgtcgatcgcaagaaggacatgatcatcgtctcgggtttcaacgtgtaccccaacgaaatcgaggacgtggtgatggcccacccgaaagtcgccaactgcgcggtgatcggcgtgccggacgagcgttcgggggaggcggtgaagctgttcgtggtggcccgcgagtcaggggtcagcctcgaagaactgaaggcctactgcaaggaaaacttcactggctacaaggtgccgaaacacatcgtgttgcgtgagtcgttgccgatgacgccggtaggcaagatcctgcgccgggagttgcgcgacatcgcctgatgtttcagcgcatgtaacagtcccgcgttatagcacggctatcgcgagcaagctcgctcctacagggaaccgtatatttcctgtaggggcgagcttgctcgcgatgcttttgaaggggcgaaaagcccattccagagccttgcacggccggatagaatttttactctaaaactgactattaaatattcttgagtcataaaagtgactgtttaggccgattttggctctaggcggcctttggcaaagctgctactctcggcgcgctttgtgacttctcggcctatgtagacagccagactcaccaacaatagacatcaataaaaaacacacacaaataataatcgcatcaaatgcgctgacgaattcgcgttgctgaggagtgggcttccatgatccaagacttttggaaggataagtacccagctgggattgctgccgatatcaatccagacgagtatccgaatattcaggcggtgttgaagcagtcctgccaacgttttgccaacaaaccggcctttagcaacctcggcaagacactcacctacggtgagctgtacgaactgtccggtgcttttgccgcgtacctgcaacagcataccgatttgcaacccggcgatcgaatcgccgtgcaactgcccaacgtcctgcagtacccggtcgcggtattcggcgccatccgcgccggcctgatcgtggtcaacaccaacccgctgtacaccgcgcgggaaatggaacaccagttcaacgattccggcgccaaggccctggtctgcttggccaacatggcgcacctggccgaagccgtggtgcccaagaccggcgtcaagcatgtgatcgtcacagaagtggcggacctgctgccaccgctcaagcgcctgctgatcaacagtgtcatcaagtacgtgaagaagatggtgccggcctatcacctgcccaaggccgtcaagttcaacgacgtgctgagccagggccacggccagccagtcaaggacgccaacccggccagcagcgatgtcgccgtgctgcaatacaccggcggcaccaccggcgtggccaagggcgcgatgctgacccatcgcaacctggtggcgaacatgctgcagtgcaaggcgctgatgggctccaacctcaatgagggttgcgagatcctgatcaccccgctgccgctgtaccacatttatgctttcacctttcattgcatggcgatgatgctgatcggcaaccacaacatcctgatcagcaacccgcgcgacctgccggcgatggtcaaggaactgtcgaagtggaagttcagcggttttgtcggcctcaataccctgttcgtcgccctgtgcaacaacgaagccttccgcaagctggatttctcggcgctgaaagtcaccctgtccggcggcatggcgctgcaactggcggcggccgagcgttggaaagacgtgaccgactgcccgatctgcgaaggttacggcatgaccgaaaccagcccggtggccaccgtcaacccgatccagaacatccagatcggcaccatcggcattccggtgccgtcgaccctgtgccggatcatcgacgacgctggcaccgagctgcccctgggcgaaatcggcgagctgtgcgtcaagggcccgcaggtcatgaagggctactggcagcgccaggacgccaccgacgaggtgatgagcgacggctggctgaagaccggcgatatcgcgctgatccagcctgatggctacatccgcattgtcgatcgcaagaaagacatgatcctggtttccggtttcaacgtttatccgaacgagctggaagacgtgctggcgggcctgccgggcgtgttgcagtgcgcggcgatcggtgtgccggacgagaagtcgggcgagtcgatcaagatcttcatcgtcgccaagccaggcgtgaccctgaccaaggagcaagtgatggagcacatgcgcgccaacgtcaccggctacaaggtgcccaaggccgtcgagttccgcgatgcgctgccgaccaccaacgtcggcaagatcctgcgtcgcgaattgcgcgacgaggagctgaagaagctgggcgtgaagaagtaaaacgccaggcaaacagaaagccccgcatccgcggggcttaatgagatggtcaacctgaccgagaagccctgcaggtttacgcttgcagggcttttctcgttttcggcggaggatctctcatgagcaccatgacgcttctcggtatcgatattggcaaacacaatttccacctgcatggccaggatgcccaaggtcatcaggtattgcgcaagaaaaccaaccgtggccagttgctcagcacattggcccagttacccgcctgcacggtggtgatggagtcatgcggtggtgcccactggctggctcgacagatcggtgttcagggccacgacgtgaagctgatcgccccgcagtacgtcaagccattcgtcaaaggcaacaaaaacgacttcattgatgccgaagcgatttgcgaggcggcgagccgccccgcgatgcgcttctgctcgatcaaaaccgcagagcagcaaacgctttcagctctgcatcgtgtccgcgaatccttgattggccatcgcaccgcggcgatcaatcagattcatggctttctgctggagttcgggatcagcctgcctattggtgccgctgcgctgcaccgtgtgccgacgttgcttgacgacccgcaacacccggttccattgagcttcaagaatttgctgatgcgtctctaccgccagattcaacaactggatcaggagatcaaggacatcgagtctgacctcaagcaacagttgaaagaggacgatgccggaagccgtttgcagagtatccctggcattggcccgatcactgccagcgccttgctggcggatataggggatgcctcgaactatcgcagcggacgtgatttctcggcttcgttagggttggtgccgaagcagcactcaaccggcggaaagacagtgctactggggattaccaaacgcggtgacaaacacatacgccggctactggtgcaaggtgcgcgggccatcatgcagcatatcgatgggcgggatgatgcgtaggggccttgggttcgagagttgctgacgcgtcgacactccaatatcgtcgcctgtgcgctggcgaacaaactggcgcgaatcgtgtgggcggtactggccaaaggcggccagtacgacccacatccgaacgcttgaacgtacagctttaccaccggcttttgcgacgtcactgactgatgacagtaaacggcaaacggcccgactgagaacctggcaataaaatcagcctcagaggctgagggttttttcaggacagtcgggagcggctactcatcgagggtcgagcgttgtggcgcaacgctcacaatgagcccggatacattagcgcaagccagctttaccgaaaacagcccatgaggttgcaggagatgggctgaccatacattttattgggcgctatcgcctcaattccctgcaggagcgagcttgctcgcgattgcgttcttccagtcgccatctcaatggctgacagaccgtaatcgcgagcaagctcgctcctacaagggcctgtttactgctgaaactgcgcgaagttcacgccggtgccggcggggcgtacgtccttgaggaacgagtccttgtcggcgctcagttccaggctcagggccgccttgcgcttgccggcgttgcgtaccaccaggccttcgagcttttcccgcaggaacagggtcggcactttcaggtgcagcaactggtcggtgcccggggtgtacagtagcaggtggacccattcgtactgcccgatggccaggcggccgaccggcagatcgaaccaccagatattgcggctgcggctcagttccgcgaagtggcagttgttgacgcccagcaccgcaccgcccagttcctggttccggcgggcgatggccagctttttatcgagtttcataacattcctacggattggatcttcagcgcagtgcctgaatacgttgcgcattctcgtgggttggtcgccaaacataaagcgcaacctgcgtgcggcgggcaaataaggcgatgaaaggccccgctgaaaataattgaaactccgcgcaacggccttgggtcaacctcagggcaggaccccaaaccctcgattgttctacggatctatggatctacggagaaacaccatgggcagcacagcagacaaggcaaaaggcctggccaatgaggccgttggcaatatcaagcaaggtgtcggcaaagcgactgataacgatcggttggaaaccgaaggcaagattcaggaaaagaaaggtgaggcgcagcaaaccctcggcaaggccaaggatgcgttgaaaaagaccatcgacaaggcctgattcactggcttgcactgcgacacgacggccatccgcggatggccgtttttacatcggccatggcacccaaacaggacgaaacggttcaaaatcgccaaactaggctagtttgttgtacaaaacggcccctgagtcgccaccgaccctgaattcttgcggcgaaaggagacgctatgttcttgccgaatttgaaaggcctgcccctgcatcgtgtgctggtgcgcacggtcactgagttcatcgacgatgaaatgtcgacctacgcctcggcactggcctatcagatgctgttttcgttgttccccttcattctgttcctgattgccttgatcggtttcctgcacctgccggactttttctcctggttgcgcctgcaatcggaactggtgttgccgccccaggcgctggagcaggtcaacccggtgatcgaccagttgcagcaatccaagggcggcctgctgtcggtgggtatcgtgattgccctgtataccgcctcggccggcgtgcggctgatgatgagcgcgatgaacgccgcttatgacgtggtggaaaaacgcccgttgtggaaacgttttccgctgtcgattttctacaccatcggcatcgccggcatgctcctggcggccgcggccttgatggtgctcgggccgcaggtgatgggctggatcgccgcgcaggtcggcctggaagactttatcgtcacggtctggaccatcctgcgctggccggtgatcgtgatcctgatgatggtcgccgtggcgctgatctactacgtgatgcccgacgtgaagcaggagttccgcttcatcaccccgggctcggtgctggcggtggtggtgtggatcatcgcctcgttgggcttcgccttctatgtgaagacctttgccaactacaacgccatgtatggcagtatcggagcgatcatcgtcctgctgctgtacttctatatttcctcggcggtgctgttgctgggggccgagatgaatgcggcgatcgagcacatgtcgtccgacggcaagaaccctggagaaagggtgcccggcgagcacgacgaacccaaacaacacgtatcgggactgggccgggaccactcgctcaagccgaccactgacgaagtctgatcatgatccgtgaaatcctcaaaatgggcgacgagcgcctgctgcgcatcgcgccatcggtgccgcccgagatgttcgacagccccgagctgtggcaactgatcgacgacatgttccagaccatggaaagcgtcggcggggtcggcctggccgcgccgcagatcggcgtcgacctgcaactggtgatcttcggtttcgagcacagtgagcgttacccgcaagccgaggccgtgccgcagaccatcctgatcaatccgctgatcacgcccttgagcccggtgctggaagaaggctgggaaggctgcctgtcggtgccggggctgcgcggcgcggtcgagcgttatcagcacattcgctacgaaggcgtcgaccccaggggcgaaccgatcgtgcgcctggcctcgggtttccacgcacgggtggtgcagcacgaatgcgatcacctgatcggccgcctgtacccgtcgcggatccgcgacttcagcaaattcggttttaccgaggtgatgttccccgacctcgatccccacgccgacgattgaaacagacagcctgaaacgtcgctttcatggaccagccggaggccggtttgccgttgaggcgggcccgcgctccagggcccgcgatcacaccctgtcgcgggtcgagccgaccaaaggatcgatgcccatggcgatcaggctcttgctcctgcgataacgctccaggcgatccgccagggcctggggcagggcaggggccgtggtaaagcccatgcgttcgtacagggcttgcaggtccggatgacagaacagccatagcggccccggcagctgcgcgcgtgaccgttcgaccagcattgcggcaacgccctggccgcgatgggccgggtcgacgaacagcccggtcagccagtggccctgggcgacgggcgtgaggttcagcgcggcaatgatcgctccccgtttcgccacccaggattgcccttcgccggccgcgcgcatcggcgaattgtgggcgcgatagaacttgttcagcagcggtcgcagggtgtcggcaagcagcaggtattgggtgtcgggcatggggtttcgcagggtgggccggggtggtgattataaaagtacgaagtgcgcgggataggtgtataccagatgaacgatcccctacgagtggagtgtgcatcatgtccaaaggtatgaatgccaaaaagacggcgaagaaaaaacccagccggaccgccgatgaaaagcgcgcggacaagaaagccaagaagaccgagcacaatattttcggccattgatcccctacgaagcccgccccgcgggcttccttgtttttgcttctaagtaaataaccggcagagctgctgcggcatctgcctcgagccttatgccgcttcggccgccagtgccgcttgcaccgcttcgcgctgggagattcgcgcctggaaacctgccagcgccggccactgttccaggtcgatggcgaagccggcggtccagcgcagcacggtgaacaggtaggcgtcggcgacaccgaaggattcgcccagcaggtaggtttgttgttgcagcgtgcggtccagcagcgccaggcgcttgaacagtttctgccggatcagcgcctgggtcgcttcgggaaactcggggttgaacagccagccgaggccgccatggatctcgctggagacgaagttgagcatctcctgcagccgtacccgctgccagctgccattggccggcgccaggcccgcctgcggcttgaggtcggcgaggtattgcaggatcgccgggccttcggtcagcacctggccgtcctccagttccagcgccgccacataacccttggggttgatcgccaggaagtcgccgccgtcggccgtggttttattgcggttgtcgacccggaccaggttgaacggcagggccagttcgcgcagcacgatatgcggggccagcgagcaggcgttgggcgagaaatacaggttcatcgagggctctccagaggggggagatcagtgtcatagtccgcactgttctcagtaaaattaatctttcagaagaatcccataaggacagctactgccatgatgaacctgatgcactggcgcatgctggtggccgtggcagataccggcaacatcacccgcgccgccgagcgggtcggcatgacccagtccggcgccagccaggccctggcgctgctcgaagacaacctgggcgtgcagctgttcacccgggagaaccgccagaccctgcccaccgccattggcgaacaggtggtggaacaggcgcggctgatgctcgcggcgttgcagaacatccgcgacaccgcggacgcctgccgggacattcagcgcggcaccattcgcctggcgagtttccccatggtgctggcgactttcctgccgccgctgctgcggcgcttcaagcagctgtatccgggcatccaggtggtggcgctggaggtcagcgacgacgaggtcgaggccttgctcgaggcgcgcttgatcgatgttggggtgctgctcaatcctgcgcccgagcgcagcgtcggcctgctggggcgcgatgcctgggtggcggtgctgccggcggggcatgccctggcgcgccgggctcaggagcagggggtgaccttgcaggagctggtgagccaacccttcgtgctggccaccggcggctgttcggtgaatgcccgcagcctggcggtggatgccggcctggagctggcggacgtgcgggtcgaggtgcgggagtggagcagcgccttcaccctggttcgcgaacaagtgggggtgaccctggtgccgcagatgaccttgccggagcaacgccagggcctgtgcgtgctgccgttgagcgtgccgatccagcgcacctttgccctggtgctggccgagggcagcgagccgtcgccggcgctgcgggccttgctcgacatgctggcccagggctgagcgcagccgctcaagtcgatacccatgaaaaagggttcccgtgggaaccctttttcgactggctgcttttaaagcgccgcgaggaacttgtcggcgacttgtttctcgacgccgttggcgtccttctcgacttgcgccagcttcagcttgtcctggacccgctgggcaatttcctgagccaccgcctgctgtttctccggtggcaggtttttcaggtcttcctcggtaatgcccatctcttcgaggatgcggtcgcgcatgcgctgctcgggggacttgctcatgtagtccttgaactcatccagggccgagccctgggtggcgctgttggcttgcgcggtgctggcggtcggcggggtggcctggagcagcacgcgggtcttggcgaaggccgccgcgacattgtcgttgaccgtgttgccggcctgctgcacggcctgggacgcttgcagggtcgcggtgttctgcacgttctgcatcaaaccgctgtacagcgcgctggcggccgcggtgctcgggtccatgtcggaccgctgggtgggctggatcgccgaggttttctgggcactgaccaacatgattgggtacctgtgtgtagggcttgtcgaaggctgcgcagcaatttgtatgccgccgcgctggaggcccctgggacggggctctttgccagggctttgcgccgattgcccggcaaggctggcggcgcgcggcggacaagccttgccgcttgcggccagcggcgaccggtcaacgctgggcgatattctccagggccaggttgcgggtacgcgggccgaaacggccgatggtgaacatcacgatcagcatgctgccgacaatgaacgccaggaccccgggcgtgccgaagcggtcgaggaaaaagccgatcagcaggctgctgaacaccgtcgacaggcggctgaacgagtagcagaaacccaccgcccgggcgcggatattggtggggaacagctcgctctggtaggagtggtaactgaagctcagccaggcgttgcagaaggtgatcatcaccccgcagacgatcagccccagggccgtgctctgccaggcgaacagggtgccgaaggtcatggcgccaagggccgagccgacgatctgccacttgttctcgaagcggttggcgaacttgacgaacagcagcggccccagcggataggcgagggtgatgataaaggcatacatcaggctgtgggtgacgctcacgccctggcccgagagcagcgccggcagccagttgccgaaaccgaagaaaccgatggcctggaacacatggaacacgatcagcatcagtgcccggcgccgatagggcggttgccagatatcggcgaaacgccccgagccctggacaccgagggcctcgggttgcggggtgtccagcggcttgccgtggtccttggcgcagcgcgcctcgatgccgtccatgatccgctcggcctcggcgaagcgcccatgctgggccagccagcgcggcgactcgggcaagcgtgaacgcaaccaccagataaacagcgcgaacaccgcgctggccaacaccacccagcgccagccggcgatgccgaacgggtcctgcggcaccagccaccaggacatcagcgccaccgccggcaccgagagaaactgcacgaaaaaggcaaaggcgaaggccgagctgcgcatgtgcttgggcaccagctcggagaggtaggcgtcgatggtcaccagttcgatgcccaggccgatgcccaccaggaaacgcatgccgatgatccccagggccgaggtctgtatgcccatcagcactgtggccacggtgtaccagatcagggcgaaagtgaagatcgcccggcgcccgaagcggtcggcgatcgggctcagcaggctggcgccgaggaacaggccgagaaaggtcgccgaggcgaaggccgcctggtcggaaaaaccgaacacgccctggctgccggtggcgaagatcccgtcgcggatcaggccggggctgatataggcggtctggaacaggtcatacagctcgaagaaaccgccaatcgacagcagcgccaccaggcgccagacggtggcgacggcgggcaggcgatcgatgcgggcggagatatcggcggcgcggaccgggtcgaggccgtcggtagcgacagtaggggcgagggacgacatgggcgggattccaggtttcggtgaagaggaatcttagctggctaacggaaatcaatgattgtgaatgcggggtcggaagccgggctgtgcgctgatttattgtcgtatttcgttacatcttggcggtttgtgccgcagcatcaaccaaagcggcatccagctcctacagaaaaaaagatgattcagggaatgccattgcgtccatgcagcaggaaggccgggcgttcgctgagccgtgcgtaataggcggcgacggcggggaagtcggggcgctccatgggcgtcatcatccagcgatgcaccgacagcccgaggacgatatcggccaggctgaactgctcgccgagcacatagtcgccgctgctcgccagttgcggttcgagcagggccatcttggcgttccagccgcgaaggccggcgacgatccgttgcgggtcctgaaagtccgggttctgccggaccagggcgacgaaggcgtagctccacgccggattgagctccgtggcctgccagtccatccactgctccaccaacgcccgggcccggggttcgccgggcagcagccgttgcccggcgaccttgccggtcaggtaccggcaaatactgttggactcccacagcgcgccggcgtcatcgatcagcaccggcacctgggcgttggggttgagccggagaaactccggcgtgtgggtcgactggaagccgctgccccaatcctcgcgttcgtagggcaggcccagttcctcgcaggtccacagcacttttcggacgttgatcgatgaggctttaccgagaattttcagggttcccatgcaagctttccttggcgggtggagggccctggaaatctaacagcggcgccgctcttgggcgataccgatttgcactctggcctcagaccgggtccggcagcgccgacgccggcaggccaaagacccggtcgaacagccagttgaagacgaaggtgtagcaggggatgaacaggatcagcgccaggtcgagcaggaaggcctgcaccaggctgatgtgcatccaccaagcgatcaacggaatcaggaacaggatcagcgtcagctggaaacccacggcatgggcgatccgccgcttgaccgtgcgggtccgcgagacctggcggctttcccaacgctcgaacaggctggtgtagatgaagttccaggtcaccgcgatgctggtgatcaccaccgccagcgggccggtgctgctcggcgaggtgccggacagcaaggccaggcccagggccgagaaggtcatgccgaacacctcgaacagtgacacgtaaaccagtttgcgcttgatgccttgcatgttttttcctccgcgttcgttggcccgggccgctccttttgcaggaagggctggcgaatgcggcgcaagatagcttcaatgtgcctgacagaaaaagtcagtagctttcaggtttattgataggtcgacatcctagacaggcgtctgcatgaatttctccagcgacagcatccagttgtttctcgccgtgctcgagcgcggttcgttttccgcggcggcccgggccctgggcaaggtgccttcggcggtgagcatgggtatcgccaaccttgaggcggagctgggctaccccctgttcgatcgcagccatcgcgagccggtgcccaccgccatggccaatgccctggcgccccacgcgcggctcatcgccgagcagctcaagcacttgcaggtgcatgcggtggagttgtccctggggttggaaagccggctgtccatcggcgtggtcgaggacatcgacaagtcccgggtgctggcggcgatcaagctgatcgccgagcgtcatccgttgctcgacatcgaggtgctgagcgcgccccaggacgatctgttgcagctgctgcacagtggtcgggtcgcggtcggcgtggccttcgccgggctcagcctgaacgtgctggagtatttccagtacgtcggcagcgagcggatgatcgcttgcatttccgcgcgccatcccttgcccgaggcgccggacgccaccctctatctggaagagctggtcaacgtgcgtcaggtggtggtcgccagccgcgacctgccgatccgcgacacccggccgctgatcgccgagtcctactggcgcaccgacagcctggccatggccctggacatggtcgagtccggcattggctggggcaatttcccgctgtcggtgatcgcgcccttgctccaggccggaaggctcaagcgcctgaccttcaagaacatcgacaacggcctgctgctgccggtgcacgcggtctggctgaagaaccagcccctgcaaaaggccgcccaggcgttcgtgcagttgctgggtgggcaggacccggcgctggcttcggaggttgccgcagaggtgaggccgtaagcctgtccgcttatggggccgggcgggtggcgtcgtgctgttcgctgcccagcgcctggtgacgcagccagtcgagcaagcgggcgacgggcgagtccgggtcgacggcctcgggcgacaacaggtagtaggcgctgccgtcggcgataaaaccgaaaggcgcgaccagcaggcccgactccaggtcgtcgcgcaccagttgccagggcgcgatggccagccccaatccagccaccgccgcttgcaggctgaagtagaaatgctcgaagacctgctccgtgcctggcgcctgttgcattcccttgagggtcaaccattgctcccaggccgctgcccgggtcgcgctgtgcaggcgtggcgccgtatccgatagtcgcgctctgccgcttgcgtcgcgggtccagccgacggcctggtccgggcgacacaccgggccgatggcttcatcgaacagccactgcgcgtgggtgtgcggcggccagggaaagtcgttgcggcggatcgccaggtcgatgccttgagcaaaggcgaagggcccgccgccggccaccagttgcagggggatatccggatgagcggcgaagaaggccgggatccgtggaatcagccagcgcatcagcagggtcggttcgcaggacagcaccagggccgcggccttgtccggcgttcgcagtttgcgggcggcggcgtcgatcaggtcgaaggcatgctccacgctgtgcagcaattcgcggccggcctcggtgagaaagacccgatggctgcggcgctcgaacagacgcgtgtcgaggtcttcttccagggtgcggacggcacggctgatggcaccgtgggtcaggtgcagggcttcgccggcgcgggtgaagctctccagacgggcggcggcctcgaaacagcgcagggcgctcaggggcggcaggcggcgatgggttgtctgtgagtttttatcaccgggaatgtcagttttcatcgttcgctctgtgacggttcgtgcccataaagtatgggccggattctatagcgaaggcgcttgaaaatgactgaactgttagtagtaatcaccatgaccatcatcgcggtcctcagcccggggccggatttcgccatggtcacgcgcaacagcctggtgctgtcgcgtcggcacggggtgttcacggcgctggggatcgggctcggggtgatgctgcatatcagctacacgctgttgggtgtcggcctgttggtcaaggaatcgctgctgctgttcagcgtgctgaaaatcgccggggcgctgtacctggtttatctcggtatcggcatgctgcgcagccgcgcggtcgaggaagaggtaacggtcgatgcgccgcgggtctcggcgtgggcggcgttgcgtacgggttttttgaccaatgcgctgaaccccaagaccatgattttcgtggtcagcctgttcatgcaggtgatgcagccaggtaccgcgccgggtgtgcagatcggctatggcgcgatcattgtcctggcccatgtgctgtggttcgtggcggtggcgctgttcttttcggcgccgggcatccgggcccggctcatggcttacaaacggcgtatcgaccagctgttcggcgttctactggtgggcttcggcgtgttgctcagcgccctgagcctgcgttcctgaatgcggctcaggtgctctcgcgcaccatcagctcgaagcccatgtccaccaccggcttggccacgctgttgccggccatcagggtcagcagctgttccgcggcgcgccggccgatggcttcgcgcggggtgctgatgctgctcaggcgcggcaccatgtgcgccgaggcgggcaggtcgttgaagcccatcaccgccacttgctcggggatcctgatgccgcaacgcatggcttccagcagggcgccgtgggccaggtcgtcgttgccgaagaagatcgcgtcgacgtccgggtggctgtgcatcagttgcaggaagagttcaccgcccaggcccaccgacgaggggcgtggggtgaggacttccagtttcggatcgtagaggccggctttctccaggccgcgacggaaaccttcgccgcgcatcagggtgcgctgatcgagctgggcgccgatataggccaggcgcttgcgcccgcgggagatcaggtgctcggcggcggtttccccggcgttgtgctgggagaagcccacgcagttcaggccggcctcggggttgaggtccatcatgtagacgcaggggacgttgctggcttcgaccatccgtcgggcgctttcggtccggtcgaagccggtcagcagcaggccgcggggctggtaggccatgtagttgcgcagcaggttttcttcttcgtcgggggaatagtggaagttgccgatcagcacttcgaagcccttgggccgcagaacctgatgaatggcttccagggtatcgatgaacagcaggttggacagcgacggcaccagcaccaccaccgaatggctctgggccgaggccagggcgcgggcggcggggttgaccacatagttgagttcgcgagcggccttctgcaccttttccaccagttcggtggccaccgtatcgatgccgcgcagcgctcgcgaggcggtgatcgggctgacgccggccaggcgcgcgacttcgttgagggtagggcgccccgtggtgcgggtatttttatcgttcttggaggaggtcatcagacggcttgccaaacaaaattcaagtcactaaggtagcgctgtctcgaaacagctgcaatgcgtgagcgcggtcggcctgacccgcactctttggtttcgcggcctatatacgcggcaacccacaaaaatgacaagaaggcgtcggcagaaactatttttgcactagagtttcgaagagcgaaggtagcgctgtctgcgcgctgaggtgtttcatgagtcaacccatcaccgccctggtcatcatgggcgttgccggctgcggcaagtccagcgtcagtgaagcgctgtgccagcgcagcggcgccatggccattgaaggcgatacgttccaccctgccgccaatatcgccaagatgagtgccggtattcccctgaacgacgacgaccgtgccggctggctcgacagcctgtgcgacgagttgcgccgcgccctggccgccggacaacgtccggtgctgacctgctcggcgctcaagcgcaagtaccgcgaccgcctgcgcagcgccacgcccggcctgggcttcgttttcctgcaattgacaccacaggtggccgccgatcgcgtggcccaccgtccggggcatttcatgccttcgaccctgatcgacagtcagttcgcgaccctcgaatctcccgtgggcgaacccctgaccctggcattggacgccaccatccacagcgttgaccggctggccgaacaggcccatggctggtggctggagcacgggctggactcaacccgataagcttcggttcacctagatagcgctatcccactcggctcacgtttttaacgcttgaataaaaacaacaaaccggaggcaaccccatgtttggcatgtcccaagagacctatctgctggtagacgcagtggtcaccattatcgggctgatcgtgctgatcacccgattcaagctgcatcccttcatcgccctgaccatcgccgcgggtttcctcggcctgacgtcgggcatgccggtggacaagatcatcaaggcgttccaggacggcttcggtggggtactcggtttcgtcgggatcatcctcgcgctgggcaccatgctcggcaaaatgatggccgaatccggcggcgcggatcagatcgcccagaccctgatccgctcgttcggcaaggagcgggtgcagtgggcgatgatgttcgccgccttcctggtgggcatcccgctgttcttcgagatcggcttcgtgctgctgatcccgctggtgttcatcgtcgcccggcgcaccggcgtgtcgatcatcaagatcggtatcccgctgctggccggcctgtccgcggtgcacggcctggtgccgccgcatccaggcccgctgctggccatcggcgtgttcggcgccgacatcggcaagaccattctctacggcctgatcgtagccctgccgaccgcgatcatcgccggtccgatctacggcaccttcatcgccaagcacatcccgggtcatccgaaccaggaactggtggaccagctggcgcgcgaaaacacctcggccaacctgccgagcttcagcgtgaccctgctgaccgtgctgctgccggtgttcctgatgctgctcaagaccttcgccgacgtggccttcccggacgggcatttcttccgtatctggatggacatgatcggtcacccgatcagcgcgctgctgctggccttgctgctgtcgctctacaccttcggttcgcgccagggcatcggctccaagcagatcctcaagctgctcgacgccagcctggcgccgaccgcggcgatcatcctgatcatcggtgccggcggtggcttcaagcagatgctggtgaccagcggcgtgggtgacgtgatcggccacatggcggtcaacgcgcagatctcgccgatcctgttggcgtggctggtggcggcggtgatccggatcgccaccggttcggcgaccgtggcgaccatcaccggcgcgggcatcgtggtaccggtggtcggcatgatccctggggtcaaccgcgagctgctggtgctggccaccggcgccggctcgctgatcctgtcccatgtcaacgacgccggtttctggctggtgaagcagtacttcaacatgaccgtggcggaaaccttcaagacctggaccgcgatggaaaccatcctctcggtggtgggcctgatcttcatcctgctgctgtcgctggtggtgtaacccgaaccctgtagccgctgccgaaggctgcgatcggccggtacggccgtagcgatcttgcaatcgctgaaggcccttcggtccttatcgcagcctgcggcagcggctacaggggcggcagacagacacaaaaaaaccgcatcgctgcggtttttttgtgcctgcttgtttgtcggcgtatatcagcctttctgcaccaggccatcggcgcggaacatgccgcggatgccgcgcacggcctggcggatacggtcctggttttcgatcagggcgaagcgcacatgatcatcgccgtactcaccgaaacccacccctggcgaaacgcagaccttggcctcggccagcagcttcttggcgaactccagcgagcccaggtgcgcgtaggcctcgggaatcttcgcccagacatacatcgaggccttggggttctcgaccatccagcccagctcgtgcaggcccttgaccagcacattgcggcgctggcggtactgctcggcgatgtctttcacgcactgctggtcgccttccagcgcagcaatggccgccacctgcagcggggtgaaggtgccgtagtcgtggtagctcttgatccgcgccagggcgctgaccagctccgggttgccgaccatgaagccgatgcgccagccggccatgttgtagctcttggacagggtgaagaactccaccgcgatgtccttggcgcccggcacctgcatgatcgacggggctttccagccgtcgtagacgatgtcggcgtaggccaggtcgtggatcaccagcacgtcgtactgcttggccagggcgatcacccgctcgaagaagtccagctcgacgcactgcgcggtcgggttggacgggaagccgaggatcatcatcttcggtttcgggatcgagccgcggatggcccgctccagttcgtcgaagaaatccacgcctggcaccagcggcaccgaacgcacctgggcgccggcgatcactgcgccgtagatatggatcgggtagctcgggttgggcaccagcacggtgtcgccctggtccagggtggcgagcatcaggtgcgccaggccttccttggaaccgatggtgacgatggcttcgctttccgggtcgatatcgacctcgtagcgatccttgtaccagcgcgaaatggcccggcgcagacgcggaatacccttggaggtggagtagccgtgggtgtcttcgcgctgggcgacggtgaccagtttctcgacgatgtgcggcggagtcgcaccgtcggggttacccatgctcaagtcgatgatgtcttcgccgcgccgacgcgcagccatcttcagctcggcagtgatattgaatacgtaaggggggagtcgatctatgcgcgcaaagcggcgcggcgaaccttgttcggccattgttgcctcgagtacgtgagcgcccggaaccgtccgagcgacgtcggccactgcggtggcctgggggcagacgataagggctgtggcgccaggctgtccagaggggcgcggcaactatttttttgccggcagcggcgttgcctggacagggatttgcatcatgcaggctggattcgcagcccgcgcattgtgtttgccgggccctcccgcgttaaataccccccactcgaacaaccgcatcgaacaggatgaatgatggagtttaccagcggctttctgctgagcctttcgctgtgcctggacataggcgtggccaatatcgcgatgattaccctggccatgcagcgtggttatttccagggtttctgcctgggcctgggcacctgtgtcggtgacctggtctacgccgtcttggcgctggccggcatgaccgtgctgctgcagtacgaagcggtgcgttgggtgctgtggatcggcgggtcggcgctgctggtgtacttcgcggcgaagatgatctattcggcgatccaccacagcgcggtgctggccgaggccggggaggtggacaacggttcgccgcgcaaggagtttttccgcggcatcttcctggccatgtcgtcccccagcgcgatcctctggtttgccgcggtgggcggtaccctgattgcccgttccggcggcggtgacctgctcagttccgggctgttcctcagcggtttcttctgcgccgggctggcctgggtcgtgggcctgtgctttgccgcgacccagggcggcaagctgctgggcgacaagctgttgcgttactcttacctggcatctgcggcgatcttctgctatttcgcggtctacgtgatcctgtccggttaccaggagttcatcgtcggcgcggcggtcgcggagcttcccgcgctctgacccagcgattcgggtttggcctctatactccctgccgaacccatttttcaggcaggagtcgcatcatggatgagcaaaaacaggtcagcgggccggtgccgcgtttcgagaaggggcgctttctgctgatcgccggtctgggcgggcgtttcactcccgagacgacgcagggcattcctgaactctgggaacgctttattccccatatcggcaaggttcccggccaggtcggggaggagacctacggcctctgctgcaaccccgacggcaagggcgggttcgaatacatcgccggggtcgaaatcagcaaactcgacgatttgcccgagctgtaccgctgggtcgaggtgccgccgcagcactacgcggtgttcgagcaccaggggccgcttgcgagcctgccgcagaccttccagtacatctggaaaacctggctgccgcagtccgggcgcgaagccgccgatgcgccggaactcgagcgctacagcgccgacttcaaccccgacaccggccagggcgtgctggaaatctggctgccgctcaaggaacagtgagccgcgccgcgagcaccggccgggcccgcggtgggcccggtcatttgcctttgttcggccggcgggcgcgccacaggtcgatggacagggtgacaaaaccgaacgcactgataccgaacagcaccagcaaaccgatctgaacattgctcatggcgacttccgtactcgaccaggatgggattgattgagccctgataaataacccggtcggcgcgcggatgacagcgactctacgcaggttttacgggcttgccgccgttcgatatgcaagccttattactttatgatcggcggcatttcccatagccgatctattccccatgaccttatccagcctgttgatccgtcaggtcgccgccgctgacctggaccgttgcttcgccatcgaaaccctggcctatgaaggcgacgaagccgccacccgggaaaagatcgccacccgcatcgccacctggcccgagggcttcatcgtcgccgaagtggagggcgtggtggccggcttcatcaattccggagcggccttcgaggtcgagatggccgacgaggccttcaaggaactgatcggccacgatccggccgggccccatgtggtgatcatgtcggtggtggtgcatccggactatcagggccagggtgtttcccggcgtctgctggaggcctttatcgagcgcatgcgcggcctgggcaaggccagcatcaacctgatgtgcaaggagcggcatgtgcccttgtacgagcgcttcggcttcgtctacctcaaggcttcggcgtcggaccatggcggcatggcctggcacgagatggtgctgaaactgtgaggtcgtaacgccacggcgtaggagccaggcttgcccgcgaaaagggcgccgcggtctggccgatgtaccgcgtcagccttcattgcgagcaagcttcgctcctgcagagccttcaatacaggctgttgcgcacccgttccggcatttcccggtcgtagcggtcggcgtcgaactggccgtcgcagaggcgcttgaggatggcgccggccgagggcagggccgagcgttccaggtagtgctcggggttccacaggtcggagcgcacgatggccttggagcagtggaagtaggccgcctcgacgtccaccaggatcaccgtgcgcgccggcttgccattcaccgcgaagctgtccagcagcgccggctcggccgagatccgcgcccggccattgacccgcagggtctcgccgatgcccggaatgatgaacagcagggccacccgcgggtcgctgacgatattgcgcaggctgtcgatgcggttgttgcccgggcggtcgggcagggccagggtgcgctcgtcgatgatccgcacgaaacccggggtatcgccgcggggcgagccgtccatgccgcctgggccgacggtgctcaggatcaccagcggcgaggcgcgcaccatggcctggtagtccgggttgaggaaggggatttccttgcgcacggcccgctcaatgggctggccgtagattgcttccagttgctcgagggtggtcagcatcatgcttctcctgggtaacgtcagaacatcagggccagacggcgttcatagccgatgcggcccctgtaggcctcgccgctgtcgacccagccttgcttcagatagaggctgaaggccgctgcattgtccgtgtccaccgacagcatcagccccttgatctctggccacgcctggcgcacggcggcgggcagggcttgcaggcaggcccggccgtagccctggccctggacccggtgactcgacctgcaaggcatgcagggtggcggtgtcggggtcggcccaatggggcaggaacggtgggcgcttgagcagcagaaacgccaccgggacctcgtcggccagcagggcgaagcccttgatcccgggctccggcgccttgagcagggtatgcagcgcggtgtagatatcgccggaataatgcttctgccgcgggtgcacttcgagcgcgtcgagctgctgcaattgcctggcgtcgagctgttcgtagggcacgagtcgggtggtcactgggctgtccatatccgggcactgagggggctgggtaagtggcgattctagcgattttgcccagggttccggttttttttcctggccctgtcgattgagcgggcggccagacgactaagggtgtcttcacgatttaacggtcgcctgcggcggccaccttgagcccgtatcactcaatcgcaaggagaatcgccatgaacgcccaaaccaccgaaagcgaaatccgcagcctgatcgacgcctggcgccaggccgtgatggccaaggacatcgagcgcatcgtcagctattacgccgacgacatcaccgcgttcgacgccgtggccgcgttgcaattcaagggcaagcaagcctaccgcgcgcactggaaggcctgcatggagttctgccccggccctggcatcttcgacttcgagcaactgcacattgtcggcgccagcgacagcgccttcgcccactggctggcccactgcggcggcaccgacgacaagggcgagaccaaggcctgctggatgcgcgtgaccgccggttaccagcgcctgggcggccagtggaaagtggtccacgaacactggtcggcgccgttcgacatgcagagcggcagcgccttgttcgacctgcaaccctgatcgtcgggtttttcgccaaagcctgaaactgcagccatagttgatcagcccgatcgaggagagccccatgaaatacctatgcctggtctacagcgacgaacagctgttgcacagcctgccggagagcccgaaggacgccgagtgcatggcgtacgccgagtcggtgcagggcagcggccggatgctcgccgccgaggccctggagtcggtgcagaccgcgaccacagtgcgcatgcgcggcggccggctgtcgatcaccgacggcccgttcgccgaaaccaaggaacagttggccgggttctacctgatcgatgccaaggacctcaacgaagccatccaggtcgccggcaacattccggcggcccgggtcggcagcgtcgaggtacgcccggtgcgcgagttgaatccctgatcgccaccctggaacaacgagccctgaaaaaacaagcataagcaggagtttcgccatgaccgagcacagcgtgggccgtgcgcccgcccaatatgagttgtccatcagccgcctgatcgatgcgccgcccggcaagctgttccgtgcctggaccgaaccgcagttgctggtgcaatggtggggcccccacggcatgactacccccgagtgtgaaatggacctgtgggtcggcggccagtttcgcaccctgatgcgcgccccggacggcaacgaatacccgaccatgggggtgttcctggagatcgtcgcgccgcggcggctggtgttcaccgatgccttcctgccgggctggattccttcgggcaaggccttcatgagcgccgaggtgaccttcgacgacctggacggcaagactctctacaccgctcgggccatgcactggagcgaagaggatcgccaggcccatgaagccatgggttttcacgagggctgggggcagagcctggatcgcctggaaagcctggtgacccgaggcatgccggactgatgccggcggtggcgcaagacagcgtcaaggcgctggtggagacggtctactgcaacgagtcgcggcggatcctggcgaccctgatccgcctgctgggggatttcgacctcgccgaagaagccttgcacgaggcgttcttcgtcgcggtcgagcgctggcagcgcgacggcgtaccggacaacccgcgggcctggctggtgtcggccgggcgtttcaaggccatcgacggcttgcgtcggcgggcgcgtttcgccgcgtcccaggcggcgctggtcagccagctcgaagagctggagcaggctgactggagcgaggaagacctggaagacgaccgcctgcgcctgatcttcacctgttgccacccggcgctggcggctgacgcccaggtgccgctgacgttgcgggagatctgcgacctgaccaccgaggaaatcgcccgggcctttctctcgacgccggccaccatcgcccagcgcatcgtgcgcgccaaggccaagatccgcgatgcacggattccttatcaggtgccgtccctgggcgagctgcccgagcgcctggacagtgtgttgcgggtgatttacctggtattcaacgaaggctattcggcgtcgatgggcgccgagctgacccgcgaagacctgacccatgaggcgatccgtctcggccgtctgttgctggaactgctgccggaacccgaagtgatgggcctgttggccttgatgctgctgcatgagtcgcggcgcctggcgcgaacctcggccaccggggagctggtgctgctggacgagcaggaccgctcgctgtgggaccgcgaattgatcgccgaaggctgcgccctggtggagcacgccctgggcacccgccgtttcggcccgtactgcctgcaggcggcgatcgccgcggtgcatgccgaggcggcgaccgccggggaaaccgactggcagcagatcgtcggcctgtatgacgtgctgttgcgcgccatgccctcgccggtgatcgaactcaatcgcgcagtcgccatcgcccagcgggacggaccgctggccggcctcgagcgggtcgaggcgatcctggcccggggcgagttgcaggattaccacctggcccattcggcgcgggccgagttctgccggcaattgggccggatcgaaccggcacgggaagcctatctgcgcgccctggaactgacccgccaggaaccggagcggcgttttatcgagagcaagctcgaagccctgaaaaccctctgaacgcctgccgatccgaagactgtggtcggccgagcggtcgtggtctattgacgatcgttgaaggccttcggccttatcgcagcctgcggcagcggctacagggaggggggcgcgagcaggggccgggagcgacctcggaaacgtcgcaatgatgcgcttttcttcagatcagccgagccctgttggccttatcgcagcctacggcagcggctacagggagggtggcgcgaggaggggccgggagcgactccggaaacgtcgcaacgatgcacttttcttcagatcagccgaaccctgtagccgctgccgcaggctgcgatcgggcgcggagcggccgccagcggggcgagcctctgcaaaaaacgcttattccagcatccgtcccagcaaccagctgcccgccggacctggcgggtgcaggcgcgaccacagggcatcgaccgccacgttgcgcggccagccacgggcatcgagttccaccaggctgtcggcgccgaaacgctccaccagccagcgcggaaggggcgcccagccaaagccgccctgggccatttccagcagcatcaggtagctcggcgccgaccacacccggccccgggcccggctgtcataggggttgacgatggtcgccaggcgcagctcgcggtgctgttgcaggcgcgcctgatcgatatttttcagtgccgccaaggggtggttgcgcgacacgaacagggcgatttcggtgcgctcgtccaccgtcgaatggtcgaggtccgccgggtattcgggctgcatctcggcgaaggcgatctgcgcccgaccgcgctggaccagctcgatcaggtcgtcgcattcggcgatcaggcattccagctccaggtccgggtagcgttgttcgaaggcgctcagcgaggtttcgaaacgatccgactgataggtgtcggacaaggccaccgtgagcttggcttccacgccctgggccagctggctggcggccatttccaggcggctggtggcggccaggatgtcttcggcccgttgcagcatgacgtggccttgcggggtgagggcgggcttgcggctgctgcggtcgaacagctgcaggtcgaggtcgatctccaggctcgccaccgccgcgctgatggtcgactggctcttgccgagcttgcgcgcggccgcggaaaacgagccttgggtggccgcctggacaaaggccagcagtacttcgtgtgaggccatgaactatcgccttgctcgatggttaatgattatgaagtatcggaacctaaggtgatcatggcaaccacattcacttgcgggagccagatcatgagcagcaccaaatccttgaccgagcgggttttccaggccgtgggcttcgagctgctggcgttcgcgctgtgtacgccgctgctggcctggatcatggacaagccctttgtcgacatgggcgtggcgaccatcgccatcggcctgatcgccctggcctggaacgtggtcttcaatggcctgttcgaccgcctgctcaagcgcctggccctggcacccagcggctggacccgggtcgcccatgcgctgctgttcgaaggtggcctggtggcggtaagcgtgccgctgattgcctggtggctgcaggtcagcctgatgcaggcgttgattctcgacatcggcgtgctgctgttcttcctgccgtacacctatgtctatcactggggttacgacctggtgcgggaacggctgatgctgcgtcgtccgctcgatcgcgccagttgaacagcgcaggggtcagcgggcggcgtggtgccgctcgatggcttcgaggtaggccttcatcgcccgggggacttcctgcaacagcaggatgctcttgagctggctattctccagggcaacctgaaacaggccgatgggcaatccgcgcatggccgtcacgtaagcgtcgcgctccgcggcgctggcggtgggcaggcgcagggcgagcatgcggtcgtaggttgcctggatccgcgcatgaacgtccggggcctggagctggccgggggcgaaggtggggctgatcatctgcagcaggtcgagatgggtctcgaggtattccatgatcggcatgatcatccggtcgatcacctcctggctgctcgactcgacccaggtggccgggtcgatggccaggaggttggcggtgatctggtcgatggcgtcgatatggcgctggcccagggcgtcgagcacgctctgcttgtcgctaaagaagtggtacagcgaaccgatggaggtgccggcttcgcgcgcgaggccatgcatggtcaggctggccactccctggctgaccagcaggtgggcgcaggcgtcgagaatcgccgtgacccgttcatggccacgagtctgtttcggcgagcgcgggtttttggccgggagcatttttgaatcgttcatggtctgagaggcagcaaggggcatacattatggcgcaccggggcgtttgcagtcctcaggtaaaactagacaccatcctctacttttgcagagaatacgcgccatggatcagcgccctccgctgtcccacctgactcgaagaccatgacactctctcccaactggatcatctgcgagcattgcgattcgctgtacgaatccgtgccgcttgcaaaaggccagacctcccagtgctcgcgctgcggggcggtgcttgagcgcgcccggcacctgaacgtgcagcagctgctcgccctgtcgatcaccgcggcgctgctgttcgtgttcgccaatgccttcccggtgatcggcatcagcctcgaaggcctgagcaacgaagccaccctctggcagtcggtcgaagccctggcccagggccgcatcagcctgatcgccgccgtcaccggcctggccatcatccttgcccccggcctgcagattgccctgctgtgctgggtgctgggctttgccaacatcgggcgcgcggcgccgggcttcaaggcctgcatgcgggccctggaacacctgcggccgtggagcatgctggaggtgtgcctgctgggcatcctggtggccatcgtcaagctggccggcatgctcgacgtgcacccgggcctggggctgtggtcgctggcgatgctgacggtgctgatcatcctgatttccggcaagggcatccgccgcctctgggacgacctggagggccgctactgatgagccagcctccctatgcccgcgacctgggcctgatgctctgccacacctgcggccagacctgcccccgggacgttcactactgcccgcgctgcgaggccgtggtgcatgcgcgcaaacccaacagcctgagccgtacctgggcctttctcgtggccagcctgattctctacatcccggccaacgtgctgccggtgatgtatacccagatcttcggcagcggcagcgaaaacaccattctcagcggcgtgctggagttctggcagcacggctcctgggacattgccctgctgatcttcatcgccagcgtggtggtgccatgcagcaagtttctggtcctggggatgctgctgattacctgccagcgccgcagtcattgggcgatgcgcgagcgcgccaagctgtaccgctttatcgaggtgatcggctactggtcgatgctcgacgtgctggtggtcgccctggtggcggcgctggtgcaattccacgccctgagctcgatcgagccgcgcatgggcattctgttttttggtttggtcgtggtcctgacgatgttcgcggccatgagtttcgatccccggcttatctgggatgtagaggttgaagatgtctgatcatccaggttccaacgcttcaagcgcgccagcgaggccgggtacccccgcggtcaggacgcgccggttcaatatctcgctggtgtggatcgtgcccatagtcgcggccctggtcggcctgtcgatgctggtgcacaagtcgctgtcggccgggcccgagatctccatcagcttccagaccgccgaaggcctggaagccaacaagacccaggtcaaatacaagaacgtggtgatcggcaaggtcacctccatcgccttgagcaagaaccgcagcaaggtgatcgccaaggtcgagctggaccagtcggcggagtccttcaccgccgccgactcgatgttctgggtggtgcgcccgcgcattggcgcaggcggtgtgtccggggtcgacaccctgctgtcgggggcctttatcggcgccgatgccggccatgaagagaagcgcaagaaaagcttcgtcggcctggagacgccgcctgcggtgacttacgggcaaaagggcaagcgcttcaccctgcgcaccgatgacctgggctcgctggatgtcggttcgccggtctattaccggcgcatcgaggtgggccaggtgatttcctacaaactttcggataacggcaagggcgtggacgtgcggatcttcgtcaacgcgcccaacgaccagttcgtcaccaccgactcgcgtttctggaacgccagcggcgtggacgtgaccctgggcgccaacggcctgaaggtcaacaccgaatccatgtcgtcgatcctcgccggcggcatcgccttcgtcgaacccaagtacagccccaacgccaagccggccgaggaaaacgccagctaccagctgttcgccgaccaggacaccgcgctggcgccgcccgatggcgacccgtactacatgcgcatgcgtttcgaccagaccctgcgcgggctggcgctcaatgcgccggtggagttcctgggggtgaacatcggtcgggtggtgtcgatggacctggattacgacgagcagaaaaagaccttctccaccgtggtcggcgtggtgatctacccggcacgcctgggcaaggtccatcagcaactggagaagctcagcggtgccgacgaaagtcgcgcgggctacctgatcggtgcctttgtccagcatggcctgcgggcccaggcacgcagcggcaacctgctgaccggccagctgtatatctccatggacttcatccccaacgccaagccggtgcctttcgatgcgaccgcgcggccgctggaaattcccaccgtgccgggcgggctcgacaagttgcaggagcagttgcagcgagtggtggagaagatcagcaaattgccgatcgatgccatcgccaacaacctcaatggcagcctgaccgagatgcagaagaccttgcagaacgtcaacggcaaggtattgccggagatgcgcgacaccctggagcagaccaagaaaaccctgaccacggccaacgacagcttcgccgaggactcgccgcagcgcctgcaactgggccaggcgatggacgaagtgcagcgcaccgcccgttcggtacgggtgctcaccgatttcctcagtcgtcatcccgaagcactgatccgtgggcggctcaaggacaatcagccggacgcctacaaatcctcgacctcgtcttctcgtgagcctgaatcggaagtccagccatgaaaaaaactctagtgttgctgatcgcgtccctgggcctggcggcctgcagctcggcgccgacccattactacaccctgatgccgccggcgcccgagccggcggctgctggcggcgcggcgtcgggcctgcaattcgaaatggccggggtgcgcattccgatgcaggtcgaccagccgcaactcgtggtacgccaggacggcggcaccctggcgatcctggaaaccgtgcgctggagcgcgccgctggtggatgagttccacgatgccctggccagccagatggagcagcaattgggcacgcgcaacctggagggtctgcccaagtccgcggggcagccgatcctgtcgttgcagaccgatgtgcgccgcttcgaatcgataccggggcgttatgcgctgatcgacgtggtgtggaacctgcgcctgcgcggcgatggcgtcgagcgccgcagcctgacctgcagcagccgcatcagccagccggccagcgtcgagctgtcgagcctggtccaggcccaccagcgggccatcgacgagctggccaagcgcattgccggcaccgccaaacgctgggcgcaaaaccctgccacccgctgttcctgaatcttccggtgcgccgtggcgttcaaccgctcagggttgagcgtctggcccgtcaggagctccccagacggccacagtccatgtagccgctgccgaaggctgcgctgggccgcgaagcggccccaaaacctgaccccgcgatcttcctgatattgcgtgttgtcccgttggccagtcctgcggactggatcgcagcctgcggcagcggctacaggtgatcgcggtgttcagaacaattgggtgaacagccagtacagactgccggacagcaggattgccgcgggtagggtcagcacccaggccatcagcaggttgcggatggtctgcatctgcaggccgccgccgttggcgaccatggtcccggccacacctgaagacaatacgtgggtggtggacaccggcaggccgaacatatcggcggcgccgatggtcagcatcgccacggtttccgccgaagcgccctggacgtaggtcaggtgggtcttgccgatcttctcgccgacggtgaccacgatgcgtttccagccgaccatggtgcccagccccagggcgatggccacggcgatcttcacccacagcggaatgaagcgcgtggcgttgtcgatctgctgcttgaacagttgcagcttgccctgggtgtcggcgtcgaaatcgccgacctggttcttgtccatcaggcggatggtttcgctgctcaggtacatgtcgttgcgcacgttgcccatggcttcggccggcaccttggccagggagccgtagcccttcacttcgtcaccgatatgaccagtcagggcggccagggccgggaccagctgcggcgtggcttccttgctgcgcacatagtcggaaagcaccgcgcgcgggtcggcgggggccggttgcggggcgtttttcaccagggcttgctgggtgacttcggccacggcggcgaattgcagggcctggtcggccggcatggtgcgattcagcgcgtaggccatgggcagggtgccgaccaggatcagcatgatcaggcccatgcctttctggccgtcgttggagccgtgggcgaaggacacgccggtgcaggtgacgatcagcatgccgcgaatccaccacggcggcggggtattgcccttgggcgccttgtacagcgcgcggttcttgacgaacaggcgcagggccaggagcagcagggcggcgaaggcgaagccgatcagcggcgagaacagcagggcgtagccgaccttggtggcctggctccagtccacgccgctggtgccgtcgcggccgtgcatcagggcgttggccacgccgacgccgatgatcgagccgatcagggtgtgggacgacgaggccggcaggcccagccaccaggtgccgaggttccacaggatggcggcgatcagcagggcgaagatcatggcgaagccggccgacgagccgacctgcaggatcagctccaccggcagcagggcgatgatgccgaaggccaccgcgccgctggacagcagcacgccgaggaaattgaagaaacccgaccagaccaccgcgaaatgcggcggcagcgagtgggtgtagatcaccgtggccacggcgttggcggtgtcgtggaaaccgttgacgaactcgaagcccagggcgatcagcagcgccacgccaagcagcaggaacggggtccaggtggtgaccgtggtgcccagctcgtgcacgtcgtgcatcaggctgtaggcggtgaacaacaggcccatggcgaggatcgcgaagaacaccacgagggtgaaggggctggcttttttgtccagctgcggtctggcttcgagggcggaggaaggggaggcggcggtcagggaaggggtggccattgccggacaatcctgtggcagggaggagtgtcgcccatgatcgttgccaaatattacagagagactgcctcaggtcagtgtttgggtgaatcctttaaccactggtcaagaagccgcgccattttctgtaggaacgagcgggcggcgatccgacttgcccgtgatggcgtctgtagccgctgccgcaggctgcgatcggtctgggccggccgtggcggccttgaaatcgccggaggtcctgcggaccttgcgcagcctgcggcagcggctacagggaatagggcctacatatcctggcgcttgcgaaacgcccagcggccggcgatgacggtgaaggtggcgaccagcgcgacgaggatccagaagccttccgggtcctcggagaaggggatgccgccgacgttcatgccgaagaagccggcgatgatgttgatcggcagcgccagcaccgtgaccacggtcagggtgaacagggtgcggttggtctgttcgttgatattggcggcgatctcttcctgcagcagcttgatccgctcgccgagggcggtgaggtcgttgatgatcagggcgaactcctcggtggacttgcgcagctccttgacatcctccttctgcagccattgcggcggccggttgagcagccgcagcagcgagcccggctccagcgccagcaggtgttgcaggcgcaccagcacccggcgcatggcccccagctcggcacggttggtggagatccgcgcggccagcaattggtcttcgatctggtcgacgttgaggctggtcttgcgcacgatctgggtcagcacttcgccctggtcgcgcagcaagtgcaccagcagttccaggggcgagcggaaacgttcgccggccttgaccgaggagcgcagcttgtccaccgaatgcaggggctgcaggcgcgcgctgacgatcagccggctgcgcacgcagacccacagggtggagatgtccgaggaaagcatgctgccgaagttgaacaccacgtcgttgaccaccgccagcagggccgagtccacatgctcgatgcgggtcgagcgcgagccttcgtgcaaggcctcgaagaattcctcgggcagggccaggtgagtctgcatccagcgttcgcaggcggcatgggccaggttcaggtgcagccagagaaacgcctcgccatcgtccggctgttgcagggcttgcagggccttggccgaatccagttcgcgaccccgctcgccggggcggaacgcaaagccgtagagcaggccgaacagatccgaatcgcgatgggcatggtcgatgctgtggttcatggaggctcgcaggagggaaggcacctgtaggcggttttacaggttcacttgagcccgatcatcgcaaggcttcatgactgttttgtgacggttcgaagtgcaatattcggcggttataaccggctgtcggaggcgctcaagaaagcctcttccaggccgatcacgcctacgacgactgcgcgaccggcttgccccggttcgcctgacagggatgttcgcacgctacccatgcccgcctcgggcgtgctctatccctgttgagagatctcattcgatgtccttgcaaaaatccctgagagcgcaagtcctggctttgttgagcggcagcctgctggcagtgctgttgatcgcgctggcgtgttttcacttcttgtccaatggcgtgcaaggttatcgcgagctgatcgaggggccgttgcgcacctcgcagctgatcgatgaagccaacctgcaattcaaggtccaggtgcaggaatggaaaaacgtgttgctgcggggcaagcagagcgccgagctgagcaaatactggcagcagttcgaggatcgccagcgcgatgtgcagggcattcttggccagctggcggccgagcccggcatagacgcggcgctcaagggccgtatcgagcgcttgcgtgaagaacatcggctgctgggcacggcgtaccagaagggccgcgatgcttttgtcgccgccggtgccgacccggccgccggcgatgccgcggtcaagggcgtggaccgcgccgccagcgagcagatgagcgcactggtgagcgagctgtgcaagcagggcagcgagcggtcgcgcgacatcagcgccgccgcccagcgcacggtgtggatcggcctgctggtgatgctggcctcgggcttgctgatcggcctgctgagcctgtggctggtcaaccgcagcctggtggaaccgatccgtcagttgatcgactacgtggcgcaactcagccgtgggcggattgccgaacgcgtggccagcagccgtcaggacgagctgggcaagctggcggtggccgccaataccttgcgggatttcctcgctgaaaccttcagccgcctgcagcgcagcgccaccgacctggacagctccagcggcgaactgaatgcgattgccaccctgatgtcccagggcaccaacgatcagttcaatcgcaccgaccaggtcgccacggcgatgaacgaaatgtccgccaccgcccaggaagtggcgcgccatgcggcggatgcggcgcgcgccgcggatgacgccgaccagtcggcccagcagggcgagcaggtgatgcagggcaccatccacaccatcaccctgatgcgtggcgaaatcgccaacaccgccgaggtgatccgccgcctggaggccgacagcgggcgtatcggcaaggtgctggaggtgatccgcggcatcgccgagcagaccaacctgctggcgctcaacgcggccatcgaggcggcccggccggcgaggccgggcgtggcttcgccgtggtcgccgacgaggtacgcagcctggcgcagcgcaccgcggcgtcgatcatcgagatcaaccagattatccagagcgtgcagaccggcgcgctggacgccgcccatgcgatcgagagtggccaggcgcgcagcgatgccagcgtcgagcaggtgacccaggccggcgccatgctggagcggatcaccgaggcggtcgaggcgatccgcgacatgaaccggcagatcgccacggcggcggaagagcagacctcggtggccgaggacatctcgcgcaacctgacggagatcaccacgatcgccagcaccaacctggataacgtgcagcgtaccgagcgcgccagccagaacctgcacgagctgtcggggcagttgaatgagttgacggcacgcctgagtgcctgatgcgccagggcatgaaaaagccgcgtggcctttcggccacgcggctttttttgtcctgaagaattacttgtcttgcttgttgctcaggacgttgccggtcttggcatccagatcgacgtcccactcgacgcccttggcgtcacgcagttccacttggtagacgtaggcgccggccgcggtctgctcaagctcggtgtcggtgatgttggcggcggtggtgccagggtgttcggccagggccgcctggttgagtttttccaggtccatgatggtgccggccttgagcaggcccgggatcaggtccgggcgcacgtcggcctgggccaggccagcggtcagggtcagggcggtagcggcgaacagggcagtcaacgttttcatagggtctttccttggggtgattcgtttaagtgggttcaggttagccggtacaacttaattcacccttaattcagcgcaagctttgcgccgtttgttcaatcgtcgtggctctcgggtctttcaagctgtgctctcgaacaggagaggcagtgatgaaagcaatgatcaaaggcttgtacggtcccgcgtttttcgccggcttcatcggcgctggcgtgtgggtgatgggcacgccggggctggccccgggctggttgctgctggtgttcgccggggcgctcggggtgtcttttctggcggagtggtggttgccctatgaggtggactggaaccgcccgcggcaggatcgcctgcgtgacgtgttgcacgcgctggtcaatgaaagcctgaacaccctggggttgctgctgttgccggggctggtgagcctgctggcgttcgatggcctgtggccgcgcggctggtcgctgtgggcgcagttggcgctggcgatggtcgtcgccgactgcggcctgaccctggcgcattacttcagccatcggctgccctggctgtggcgtctgcacgcggtgcatcacagcgtgcagcgcttgtatggcttcaacggcttgatgaagcatccgctgcatcaagccgttgaagccagcgccgggctgttgccgctgctgtttttgggagtccccttgccagtggcgcagctgctggcgtttgccattgccatccagctgctgttgcagcactccaatgtcgacatgcgccccggtcccctgggctgggtgtttgcctgggcgccgatgcaccgctttcaccacatgaagtacggcaccgccggcaatgtgaatttcggcctgttcctgaatgtctgggactggctgctgggcacggcgttttattcctcgacctacccgatccgccagggcgacctgggcatcggcagccagccggattatccgcaggcgtactggcgacaattgctggcacccttcagcaggcaagccgtgcatgaggaaccgccggtgcccttgccgttgcgccgttgagtcagtccagcaggcgcagctcgatgtgttgcagggcttggcgcgcggtgacgccgaacagggttttcagggtgcgggagaagtgtgcggaatcggcaaacccggcgccatgagccgcctcggtgatggcctggcccgccagcaccaggcccatcgccaggcgcaggcgccgccacagcaccaggcgccgcaccggcaacccgagctggccgctgaacagccgctcgagctggctcagggacaggtgcgcatgggccgccagggcgctggccgagaccttgccggccaattgtcggtcgaggacctccagggccttttcgatccgccggttctgcaagattcggcgcgggcaacgccgcagcgcctcggccagcgccggcagcgtcagctcggcacccagcaggctgtcttgcagggcctgggcgtcaatcgtcagcggttcggcgtagagggtgaacagggtcccgggcgcgtcgaggatcgcatgccgttgcatggccgggatgaacacatgctttgcggtgcagggctggtcgtcgaggctgacggtgaccggtgcggcgggggcgaggatcagttgatgggcgtagtgggcgtggggcgcggtacgccccagctcgccctggatcagtccgtagtcacgcccgagccacagctggcctgtccactcgggcgtgcgcacggcgaccggctcagtagccgttggcctcgagcagctggctgacgctgccgctggccggacgcttggcgtacttgagcagctccgcggcgcggttggtgaagataccgtcgacacctgagtcgaggaccttcttgaagtccaccggctcgtcgatggtgtagacgtgcaccagcaggccctggtcgtgggtgaactggttcatccagggttgcaccaggtcgaagtagctctggtcgccgccattggtgagtgccgccgacgggccggtgccgatggcgccctgggccttggcgtagctgacccactgctcgaactcggccttgtccttgggttcctgcttggcgtagtaggccgccttgtccttctcgccgctgttggcgaaggttacgtcggacttgggctgcatgccgccttcaccgatccacagcaggaggatcttcggcactttcggcatttctttctgcagcagttccaggctgctcttctcgaaggtctgcaacaccaccttgcctttgccctggcctaccgccaggtcgcttttcgccagcttggagccggccgggctgagccagccgcggtcctggagtttttccttgaggtcgtgctcgatgccggggaactgcttgggctccttggtctcgatgtacaggccaggtttgtgatgcgggttgctctgggcgatgtcgatgatttcgtcgagggtcaggatcttcaggccgacgtagcttgcacgggcacggtcgggataggcctggttgaaccaactgccggcgtcgagggttttcagctcggccatggtgaaggcgttggccgggctgtccttgcgctcgggaaacttgctggcgacgtcggtggtgcgctgcaggttgttgtcgtgcagggcgaacagcacgccgtccttgctgcgttgcaggtccatttccaggtagtcggcgcccaggtcgcgggccagtttgtaggcggcggcggtggactccggtgcatcgaaggacgcgccccggtgagcgatcaccgcggggtgtggaatgccttggctgacagccagtgcggtggggcttgggctggcggcctgtgcctggcccaggccaagcatcaggctcagcatcagggcgcttttggtgaaggtggcaggcatggtcgaggtcctttcgtggagggcgattttcaaaggactaccttttaacaattgaatggccgttgtgctatcgcgaaaccgacataaatctgcaggtgcggcaaattttccgacgcttttgcggggtgctttgcagtacgcttgcgccctgaagtttccccgtcagagggaagcgcgaaaacatttccacccttgcctggcgtgtaaaccatcgatcacctgtccttcgggacactcagtgaggtttaccatgcgcatcacatccgaactcatctgccaggccgccgaccagctcaagggttttgtcggtttcaaccgcaagagcggccagcacatcgtgcgcttcagcgaagactccttcggcatggacgtcgccgacgacgccatcacccccgccagcgaattcgtctgggccagcgccgagggccaggtcatggtgctcaagcgcgagctgatccagttgctgctggaacagaacatcgacgaccgcatcaacatcagcgaacccttgcgcgtgtacatgcgccgcaccgacctgccggagatttcggcggtgcgcagcctggtgccggcggcgcaataaccaggatgcgcggtggccgggctggcgatcaggtctcagcgttcgaacaggtaggcgcgttcgaccttgcacactcgggtgtgacaggccgcgtaccagtcgctgcgcccgcgttcgcgggcgatgcggtgttcggcatgctgcttccaggcgaggatcgaggcctggtcccgccaataggagaccgtgatgccgaagccgtcctcgttacgcgcgaactccaggccgagaaatcccggttgctgccgcgccagttcgaccatgcgttcggcggcctgctcgtaggccgggtccggctcgcggcgctgggcgctgaaaatcaccgcgtaatagggcgcctcgggggtacgggcgatcatgcatgccgctccaggcaagcggcgagtagggcgctgaccaggggcggcacgacgcctttgagcgctgcccgttccggctggaacagggtggcgacaaagaaccgctggtcgcgcagttccaccgcccgcaggtcgccggccgagtcgtagccgctggggcgcaggtcgtgcttgagcagttgcgccgcgaactgcggattgaccccgtagcgacagcgataaccttcgctgatctgctgctcgccataggcttcggcgatgcggctgcctgcgctcagatgaatgctgtcggtagcctccaccaaggagcaggtcaacggtgtgagcaaggcgcgtgctgcttcgggatgggtttcgccgtgttcggcatcggcccagcccagcacgttgcgtgcgtactccagcaccgcgtgctgaaaaccgccgcaggtgccgaggaagggccgctgctgctcgcgggcaaagcggatcgcccgcagggcaccgtccatcgagcggtaggggctggcgggcacacaccagatgccgtcgaactcttgcagtggcgcgtcgctggtcaggctgtcggtggccagccagcggtagtgcaccttgaggctggtttcctcggcggccatttccagggccaggggaatggcctggtgcgcggtgacctgagggtcgtagtcgcccaccagggcgatgtgcagggtcggcggatgtgcgatgtgcggcatggatttctcctggtagggccaacgcttgtcggttgctggatgccactatagattggcgctcacgcactcaatattggcgtttatccaagtgatcaatgcagccacgcactatcggctcgactactccgacctgtcgctgatcctcgccctggtgcgtggcggctccctggcccgcgcggcggcgttgttgaaggtcgatgtgtccacggtgttccgtgcggtgcggcgcctcgaggccgcgctgggccagcagctgttcgacaagagccgcgccggctacctgcccaccggcctggcccgcaccctggccgagcaggccgaacgcgcggaacaggcactggacgcggcacaggtcggggtggagcagggcggcgcggtggtcagcggcacggtgcgcctgacctgtaccgactcggtgttgcagggcctgctgttgccagcgctggcgcacttcatgccgcgttacccggcactggccctggagctcagcacctccaatgatttcgccaacctcagccgccgcgacgccgacctggccctgcgcctgacacgcacgccacccgagcacctggtgggccggcagttgcgggcggtgtcttaccgggtctgtgccagcccggcctacaggcagtcggtcgcctcgacggatctggccgggctgacctggatcgccccggacgattttctcccggaccacgccacggtggcctggcgccggcaggtgttgcccggtgtggtgccgggctatcgctgcaacagcatgctggcggtcagcgagctggtgaaggccgggctgggcgtggcggtgttgccggatttcctgcttgacgacaccactgccctgcaacccctgagcgacccgctgccgggctgcgacaccgcgctctggttgctgacccgggccgactgccgggcgctgcgcgcggtggtgacgctgttcgacgaattgagccagcgtctgcgcgcgccgcagtgagtcatgcctggggcgggtccttgtgcaggacgtgccggtgcatttccgaagtcaggccctcgatacgttcggtcagctgtttggtcatctcggtcaggcgggtgttctgctccagcagttcgagcagttgcgcgctgtgttgcgcggcttgcgcctggcgttcgctgttggcgatagcgatggcttcgcggtgctgggcatcggcgtcggtctgggctttgtcgcgcgcggcctggcgggtctgggccagcaggatcagcggtgcggcataggccgattgcaggctgaaggccaggttgaggaggatgaaggggtaggcgtcgaagtgcgtcaccccgctcaggttgagcccgacccagatcagcacgatcagggtttgcgcgccgagaaaggtcggggtgccgaaaaagcgggcgaaggcttcggccttcagggcaaagcggtcggtgccgaaggtcggggccagatgggcatggggacggtggaaacgcaggtggtcgacaggggcggctgaggcggttgcggatggggtcgggttcatggcgggctcggggcgatgggactgccggtcactatagcccgttgcccgacgccttccctggcgtcgacgtcgttgattcagaggcgccggttcagagcgtggcacgctcgttggcgaacatgctcaccgcctgtaccgcctcgctggcaccgtcgcgaatctgcaggatcactgtgccggcctgatccgccaggtccacgcccttggccgcccggtcccgggtcccgtccatgcttttgatggcctgctgggtttcttgctggatcatgtcgatcattcccgagatttccgcggtcgagccgctggtacgggcggccagttgccggacttcgtcggcgaccacggcaaacccccgaccctgttcgccagcgcgcgcggcttcgatcgcggcgttgagcgccagcaggttggtctgttcggcgatcgcgcggatggtgttgacgatggcggtgatctgctcggagcgctcgccgagcttggcgatcagggtcgaggagtcttcgatgttggcggcgatctggcgcatctcgctggccgcctgctggatcaccgcggtgccctgttcggcgacttgccgggtttccaccgagatgtgataggcctgggtcgcgctctgggcgtcctgggcgtgtttctccaccctcgcggttacgtcggaggcgaacttcaccaccttgcacaggcgcccggcggcgtcgtacaccgggttgtaattggcctccagccacagcgattgcccgcgtttgtcgacacgctcgaactgcccgctgaagaactcgccctggttgagacgctgccagaagtcctggtaggcgctgctgttggccagctcgggcttgcagaagatccggtgatgcttgcccttgagttcggcgaggctgtagccgaggcgatcgaggaagttctggttggccgtgatgacgctgccgtcgatgttgaactcgatcaccgccatggcgcggtcgatggcgtgcagcttgcctctggactcgctttcctgttggaccttctcggtcacatcgagggcgtacttgaccaccttgaagaccttgccgtcggcatccctgatcgggttgtagctggcctccagccataccggctggccttgagcattgacgcgctcgaaggtccccgattggaactggccgtttttcaggcgcgtccagagctcgcggtattgattgccgcgggcgaattcggcattgcagaactgccgatgggggtggccgatgacctgctccgcgcgatagcccatggtcttgaggaagttgtcgttggcccgcaggaccgtgtcctccaggtcgaactcgatcaccgccatcgaacggtcgatggcctcgagcaggctggcttgctgggcgatggtgtggtgcaaggcgtcgatggttttgttatggcggttgaatagcatgatggctggtgctcagtgggaaaaacctggagtcagtccctgttgtctgcgcctgcatgccgaaagccccctgggcctcggccttgtctgctcaatgccagcattccatgactgacagataccccttggaagggcacgcccctgtccggcgcgtacccttgctcaacatctgaggtgagacgctgggcctgcgagtcaatttagggaagttatgttgcacggcggcgaatatgccgcgcgttttttttaggcaaccgcatggcggcattatgccggcttggtggggagcgatgcgggtaaaaattgtacaaagctgcgggtttttacatttttgtacaacttttcaggagccggtggacgccgccaggagcgcgtcgtttatcgggggggcgacagcgactttgttgcgcccggtgtttttcgcggcatacagggctttgtcggcctccatgagccacattgcggcatcgcgcagccccgggtgccaggcggccaggccgatactcaggctgacccggagtggtggcacgcccggatggcgatagttgctgaagacttgccgcagtcgttccatcacttcgtgggcctgctggatcgaggtcgtcggcaggatcacgcagaactcgtcgccgccatagcgcccggccaggtcgtcctggcgcaggttgtgcttgaggtcccggctcaattgatgcagcacggcatcgccgaggatatggccgtagctgtcgttgatgtgtttgaagtgatcgatgtcgatcaaggcaatggtgccgtgacagcgttgctgctggcatttggtgaacttgaggtgcagcaggtctttccacgcgccgtggttgagcaggccggtcaggctgtcggtgcggctcagcgcgctgagggtgcgcttgtgctcggagagcttgatcgccagccggtagcagaccatacccaccgccatcgggtagagggtcagcatcggcaggcaggcgtagatctgcagctgggtggcatccccggtgaaggcaggaccgagcagcaaccacgacagcagtatcccgctcagttgtgccatggagccatggatgaacaggcgcaggccaccggccgcgacgttgttcattgccatcatggccagaatggtcaccgtgggcagcggattgaactgcatcgccgccgcccagaaaccaccgaagagcgagtcgcacagcaggttgcggcgttcggcctggtaggggaaggccgcgcgggtcgagatcaggtatgccagatgcggccagataaagccgttgaacagcaggagcagccaaacccaggtcggttgcggcagcgggtacaagccggcgaatacgctgaggctgccaatccccagcccgacgatcctgggcaggtaaatacgtttggcaaacgacagccctttgccttgttggttatccataaatttctgcgcgagcccgggtttgaaacactttgtggtgtttttattggccgtcacccttcattgggcaaggcggcgaatattgtcatttattccaacaagaataatcagtgtccttgcaggccatttagtggaacgagcgtacgcaaatgcccattgcagagcactcggtgcaagtcatggcggccggcagatccgctgtcggagccaatcgagggagaagggaatcaggcttgatagcaggccaggaacatgtccagcgtggattcgacgacgcgctgctgttcgtcttccttgaggggcggctgattcatggtgatctgtggccagaaggcaaacgccttgagcatgccgtggagctgctgggcggcgaagtgcgggtccagcggcttgagccggccgtccgcccgggccgagcgaatccacaccatcaggctttcttcacgctcgcccatgcgcgccaccatgtactgggcgcgctcgggggaatgcagggtcgcggcaatggcgacccgcgccaggttgaggaagttgtcatcggccagcagttgcagcttggccatcaacaattcccgcaactgttcacgcagggttaatccggggtggtaaagaatgtccgcccgcgccctgatgctcgcccataacttatgcatgatctcggtgaacaactcctccttgctggggaagtggttgtacaccgtgcgcttggacactccggcggttgccgcgatcttgtccatgctggtgatatcgaacccgctggcgtggaattcggtgattgccgcctggatgatggcttcgcgtttgaggtcggtcaggcgcttgggggctgtcataagttgggttcgatggcggtcgttggcagttatccggggcagtttacttagtcccgggtttgttgcaatctagaaaaactacactgtgcagtgtagctcatggcagaaaaaatgatggtcggctgacgcttgcgtgcattggcctttgtcgttccgcagagaatcaccggagccttgtcgggttccttggagtcactgattcatggccactctctcttcccgtgcagacagcgtctcacgccccgaaacgtccctgcaggaacaaggggcgttccgtaatcacgcgccggtccggcgtgccgggctgggcaggacgctgagtattttctggcgcatgttgttccacaaaccgcgtaatacccgcccggtcggggccatcccggtgcagccattgacccacgaacagctgctggcggcgccgaaccagagcgtctaccgcctagggcattcgacggtgttgttgaagctgcacgacaagttctggatcaccgatccggtattcgccgaacgcgcatcgccggtgcaatgggccggtcccaaacgtttccaccagccgcctatcagcctggagcaattgccagcgatcgaagcggtgatcctgtcccatgaccactacgatcacctggaccaccagaccgtgctcaagctggcggacaagacccgccatttcctcacccccctgggcgtgggcgataccctggtgaagtggggcgtgccggccgacaaagtgcgccagctggactggtgggaaggcacggaagtcgatggtattcgttttatcgccacgccttcccagcatttctccggccgtggcctgttcgatggcaacagcacgctgtgggcctcctgggtgatgatcgatggcgatagccggatcttcttcagcggtgacaccggttacttcgacggcttcaagcggattggcgagcgttacggccctttcgacctgaccctgatggaaaccggcgcctacaacgtcgagtggccgggcgtgcacatgcagccggagcagaccctgcaggcgcatatcgacctgaagggccgctggttgctacccatccacaacggcacgttcgacctgtcgatgcatgcctggtatgaaccgttcgaccgcatcctctcgctggcctgggaacgcagcatcgccattgccacgccgcagatgggtgaggccttcaacctggcgcacccgcagcgggggcacgcctggtggatggaggtcgaccccgtggccgagcaggtaacggcaagcgatctgtagacccttcatcggctactcccagagccctgccatcgccaggttgccgtgtccgggcctggggagtatctagagaactcccccaataccttcgacggacctggtgatggcttatcggcttcatctgtttggcgcgtctggttccggcaccacgaccttgggccaggcgctggcccagccgtttgggtatcgcccacttcgattccgataacttcttctggcgccccagcgaacagcctttcagcctgcgccgtccccgggacgagcgcatccagctgttgcagcagcaggtggccgggttggacagctgggtgctgtccggctccttgtgcggttggggcgacccgatgattgaggctttcacccatgccattttcctccgcctggaccccgaggtccgcttgcagcgtttgcgggtgcgcgagtttcagcgttacggcgagcagatccatgagggcggcgaacgccatctcgcgactcaaacctttcttgcctgggcggctggctacgacacgggtggccaaggtacgcgcagcctgcgccggcatgagagctggatcaccgggctgagctgcccggtaatccgcctcgatgccactcaccgctcggtgcaggcattacaggaagaggtattgagcgccctggatcactcgatcatggcgtagtcgggccgttccatcgggttgggcgtcgcacccttgatgttcatgccacgccctggagcgaaaccggggaagaacaccaggccttctgcttccaggcgaaaggcgagggccagtcgggtcacgtcgagcaattcgccgcccgcctcgaagcggtgaatggcggctatcgagacgccggattcctgtgacagctgttcctggttccaacccagcatggcgcgggcctgaatacagtgttctggggtgaactggaagagggcaatacgttccagggtgactttcatcgcgagtgcggccatgggatttctccggaagcgggtgaagatgagtcgataaagtactgtttatttgtacagttgttttgctcccggatcaaactcattttgccgatcgcctcaacgtcttcgtgacaagtcttgtcccggcgctatgccccggtttcgaggtaggcgctgggcggttgccccactacccggcggaacatggtggaaaaggcggcggggctgtcatagccgaaatcgagggcgattcgtgtcaccgcctcgcctgcggccagtcgggtcaaggccctgaccacgcaggcgcgctggcgccactggacgaaactcatgccggtctgctcgcggaacaggcggttgaaggtgcgcaggctgatatgcagccgttgcgcccattgctcgggagactggtgggcatcgggttgttgcaggaaggcctggcacagggtgagcagacgtggcatttcgggcaggggaatgtgcaggggcaggcgggtggtacggctcagttcatgcagcaacagattgaccagcacgccgtcgcgtccgttctcgtcgtacgccagcggcagatccaccgcctccatcagcaactggcgcatcagtggcgacacgctgatcacctggcactcattgcccagggccggcatggctgccggctcgatgtacaggctgcgggtactgaccccgagcatcagcacctcatgggccacccgcggtggaatccataccgcgcgctgtggcggcaccacccagcggccattcgtggtgctgacctgcatcgccccggtggcgccatacaacagttgcgcgcgacgatggctgtggctcggcaacaggtggccctgggggtaatcggtaccgatcgccaccaccgcgcgtggggtgcgatccagcaggtcgatcgaagtgttacgcatggcgtcggcgtccgcgggttggcgtgaatgcaaacagtattggctgacttgctaaagccggccaagccctggcgctctatcgtcgaggtcttctgctaacggagagccttcgatgttttatctatggctggctgtgttcggctgcatgagcgggatcagcgcggtgctgttcggctttggcggcggctttgtggtggtgccgctgctgtatcgcatgttgctgagcagccatggcgctgacgatgccgtcgcccggtcggccatgcatatagcggtcgccacctcgacctgcgtgatgatcgtcaacgcgctgatggccaccggcaaacaccgccgcgcgggcaacctgattggacattatctgtggccgctgggtggctacatcgggctgggagcgatagcgggggcggtcctggcaatggcggtgagtggtgaggcgatgcgctacgcctttattgcctacctggcgctgaccattgccgattgcctgatgcgtcgtggctttcttgaacagggcgacacccgtgcgccgcgctgcctggggcgactggaaaacaccggaggcctgggcatcggggccattgctaccttcctgggtgtcggcggcagtgtgatgaccgtgcccctgctgcgccgctgtggcttgagcatgacccaggccacctccatggccaacccgctgagcgtgccggtagccctggccgggaccttgacctatatggccatggccggcttcagtcgcttcgatctgggcccctggtttatcggctatatcgatctgctggcctttgccgtgctgaccctcggctcattgctgggcatgcgcctggcctcaccgtggatcgggcgcattcccgaccggctgcatgcgcgggtgtacatcggcctgctggtgctggtgatgctcggcatgctggtccgctaagggttagcccagcgccaaccccggcgcttcacgaatgatgaagtggtcgaggttctcgatgttggcgctgaataccccgaacgtctgttcggggtgttttttgctcggcacctgtttcagctccggggtcacgccataaaagaagcaatacagctcttgttcgctgtcgatcgcatgcttgatctcttcgaggaaggctttgcgcttgcggtagctctcgatcagttttttgctcaggtagacattgaccgagtagggtttctttttcgtctcgtccgcctgtttgaaccagaccttctgttcgaagtcgatgcgaaagctctgggtgtagtccttgatctccttgatcttgccccagtagatcaaccccttgttgtccagcaggtattcgatcttcttgaagaacgaggcataggacgccgtgtgttcgccgatcttcagcggcatgcgcttgagcagctccttgtcgtcgatattcgacacaaaacactccaccggatgggcgaagacactggtcttgtctggggtgccggcctgagccggggccggcgtgcgcgggctggaggagggggctggcgcggcagttcctggcgtatcgccatccgctgccgggctggcgggcttgcgcacatattcgcggcgggccagcagcaattccgatgggaaatgctcctcccgatcatcctcgtccggcgtaccctccaccccggctgccagcgtcctgctggtgccatacgggcagccttcgatatgccgggtgccaggcaggttcttgaaatgcggggtgcggatgtaattgacgttcttggcattgaaggtccccaactgattgtcagcggcaaaggcggcgcgacaggcatcgttggggcactggaactgttccttggccgagtcgaaggccatggtctcgtcgaaattcagatcgcgcacgtcatagatcgacagcttgtcgtcgaggctgatgcagtaggcggtgtcgaatttcatgggggctcgggtccttgagtgaagaaggctattaatagcgggtggcgcagggcagtgcactgatcttttcaagcatgggcgctgatctcggcataaccttgtaggtagcacgttctactcatcaccggaaaaggctcaggttcatgtctgacggtaatcgcatcaatatcggctccattggtgatgccaaccacatcaacattgcccagaatcaggcgcctgaacgcaccagcattcagttcgtcatcgatccggggagtgtcgagcgggtgagccggggcagcgtcatcaaaggcgcggtggcgttttttctatcgctgccggcgctggcgctttcggtcatgtcgatcctggccgacgcgttgggcatcctttcctacttcaatgtggaatcgcggatcctggcctacctcatcatggccgccgccatgggcggggtgatgctgtgcaacggcaagcgcaagatggccaccgccagcattgcgcccgaccaggcccgattcatcgatgggcgttgggtcgagcgtgatgaaagtggcgattacctgctgtatcgcaataccgcgccctgcaattacgaaaactgccacggtaccgtgcgtatccagacgccaccgccgcgcgaacagcataaccacgatctgattggcgtctgcgatatcggcggcaagcaacacacctatcgcgtcgacttcaatggcgtcggcgaacggcagcatttcgactggcgtccacttgaacagaacaagccatgaccccgttccaaccactcccttggtagggcgagcgtgctcgcgaaaaatcccccgtcaggccccatcaaactgacaaccttcctgagtctttccaggtcatcgcggctacatgaggggcacgaaatttcctacagttctaattaacaaaactctcaccatatagagacgagtcctacgcgttaaagtttgtaaaaacaaaatcttaggtgccttgatcagtcctggcagagaacgtcacagctttggcaaggagggacaagtaagcctcgaacaaatggccgataagaaggcgccggcctcatgaatgaaggcccggtgggaaccagccagacggcttttcccctcacaataacgaggaccttcatatgcctgttgttgcgcgttcattgttgttttgtctggccctgtccggcacaggggccgtcctggcggagccggcagccttgccttatctgccggccaatcagttccggctggctgactacctgccaccgcctccaactgttgattcatcgttgcaacaaagcgatttaacagccgtgctggcggcccaggcagcccgcagtagcgctcaggtgagccgggtccagcaggatgatgaatgggaagacagcgtgttccacttcgccagggaatccctcggcgccggtttcagcattgagcgcctgcccctgacccgggccttcttccggcgggcccaggaagacctggtgcaattcctgatgccggccaagcacagctatggtcggccgcgcccttacgaagcatcggcactggtgaagccggtactgccgccaccggagggcgattcctaccccagcggtcattcgatgaacggctatctcaatgccaccttgctgagcatggcgctgccggagaaacgcagcgagttgttcagccgcgcacagatcaatgccgacagccgggtcatcgccggcgtgcattttcccagcgacctggagggcggaaagatcagtgccgcggtattggcggcccggctgctggacgatccccgcgcggcggcggatttcgaggcggtgaaacaggagatccgtggtgccttggcctccgctgattgagttccgggttggatgatttgcctggagtcggggataccgggtcccaataaaaaagccctgagcaagtcagggcttttttgatctttcgttgtgccgattcagatcgaaatcgagatcggcacagggctggagctcggaatcaatcccagctcagcgcgccgccagtctgatactcgatcacgcgagtctcgaagaagttcttctctttcttcaagtccatgatttcgctcatccatgggaacgggttggtggtgcctgggtattcttctttcaggccgatctgcgacagacgacggttggcgatgaacttgaggtagtcctccatcatcgccgcgttcatgcccagtacgccgcgcggcatggtgtcgcgagcgtattcgatttccagttgggtgccctggaggatcatctgggtggcttcttccttcatctcggcatcccagaggtgcgggttttcgatcttgatctggttgatcacgtcgataccgaagttcaggtgcatggattcgtcgcgcaggatgtactggaactgctcggcgacgccggtcattttgttgcggcgacccatggacaggatctgggtgaagccgcagtagaagaagatgccttccagaacgcagtagtaggcgatcaggttgcgcagcagttccttgtcggtgtcgacggtgccggtttcgaacttcggatcggagatcgaacgggtgtacttcaggccccaggccgctttcttggcgaccgatggaatctcgtggtacatgttgaagatctcgccttcatccatggccaacgattcgatgcagtactggtaggcgtgggtgtggatcgcctcttcgaacgcctggcgcaggatgtactggcggcattccgggttggtgatcaggcggtacacggccagcaccaggttgttggcaaccagggagtcggcggtggagaagaagcccaggttgcgcatcacgatgcggcgctcgtcgtcggtcaggccttccgggtttttccagagggcgatgtcggcggtcatgttgacttcttgcggcatccagtggtttgcgcaaccgtccaggtacttctgccaggcccagtcgtatttgaatggcacgagctggttgaggtcggcgcggcagttgatcatgcgcttttcatcgacggcgacacgggcggaagcaccttccaactcggccaggccttcggcgatgtcgagctggtccagagaggccttggcacgggcaacggcagcggaatcactggcggttacggcgcgggcttcgagagcggcggcaccaccggcgctgtcgagtttgtccatggcagcttcggcagcgtggccggcgttggcgcctttaacggcgacttcgccttcttctttgtcgaattcgtcccagctcagcatgacgtgtcgtctcctgcgtgagggccagatgcccgtgtgaaacctgatggttggcttttcacacggccgaactggccgcgttggatcttaaggaatcgtttgttgcggcagctaacgcaggcaataaacaaaaatatgtacgggagttccgaggcggttatgggcacagaggaccgagtcgactcctgcgcgggcttcggattggctgtttatccctgtaagggaatattgcaggcccgttttaaggccgcattatagggatttttttgccgctgtggtgcgacgaagtggctcacgattcggtcggcgaggggcgtgatcgcggcggagcgagggtttacaaggctttggccggcaaagattttttttcacccggtttcgcgggtttttaccgcctggaagcgatccgagacctcggctttttcgtgcaatgctctgcaagccccgtagtacatggcttacagggaagatcgtgggctttggtagacaggattgtgttcaattcatggtgcaaattgtcattcggatagtttgctcaaaaaataagcaaaaaaacgcttttgccactacatcttgtgttggatggtcaatttttgacctttgaaacactactgtcccgggttgccacttgaggtcgttcttgatgctcgagaaggcattttcggaccatcatcaaaccccttggggcgatacggaaacgctccctgcaaggtggctcgacagaggaaaaaggggagtgcgaaagccgtggtcgcactgcattgggcgatggcttgcaaccagtctggattcagttgtgcgtctggccatctttgccgcaagaaagatctcttgcggccggcaattgttggaactttaagagaaactttagtatcagccgttagagcagccgttacccatgacgtggtattgcaggatatgtcgcaggcctttcgaatcttcatattccatacgcgcaggtacaacttcgcatacatttggaacttcgctcatggatataactttggcgatgtccaggtcggacgagtaagagtattcctctacggctggttgctggcttgcgacatcagtcgggatctcgtcggccattgctgtaacgcaaagactgctgagggccagaactaataaagctttcattttgatttcacctttctaaggtcgtgtagggtcacgcagcctttgtggggctgcgtgtggaacttgagtagaagtctggattaactgccttcgtgggggctgtaacttggttaatcacattgccttgttggcgaggttgattttaggcgcctgagtaggcgctatacaggcgtgcttttgataaacactattgacggtttttgtaacaatcccggtaaaaacgaccttcagtgacctggcagcggtcttctacttgccgcagaaactgccgcaagtcccgtaatagagggggcaaagcactttccagggggatcggctgggggttgttactaccatcgtcgaatggttctataggcccgccccggctacaacggggtcatacaacaacaactatgtcaccgaggtaagaaagatgagtgcggcttctctgtatcccgttcgtcccgaggttgcggccaacacgctgactgacgaggcgacctacaaggccatgtaccagcagtcggtcgtcaacccggacggcttctggcgcgagcaagccaagcgcctcgactggatcaagcctttcaccacggtgaagcagacctccttcgacgatcaccatgtcgatatcaaatggtttgccgatggcaccctcaacgtttcctacaactgcctggatcgccatctggccgagcgcggcgatcagatcgcgatcatctgggaaggcgacgatccttccgaaagccgcaacatcacctatcgcgaactgcacgaacaagtctgcaagttcgccaacgccctgcgtggccaggacgtgcaccgcggcgacgtggtgactatctatatgccgatgatccccgaagccgtggtcgccatgctggcctgtacccggatcggcgcgattcattcggtggtgttcggtggcttctcgccggaagcgctggccgggcggatcatcgactgcaaatccaaggtggtgatcaccgccgacgaaggcatccgcgcgggcaagaagattccgctcaaggccaatgtcgacgatgcgctgaccaacccggaaaccagcagcatccagaaggtcatcgtgtgcaagcgcaccaatggccagatcaagtggaaccagcatcgcgacatctggtacgaagacttgatgaaagtggccggtaccgtctgcgcgccaaaagaaatgggtgccgaggaagcgctgttcatcctttatacctccggctccaccggtaagcccaaaggcgtgcagcacaccactggcggctacctgttgtacgcggccctgacccacgagcgcgtattcgattatcgtccgggggaaatctactggtgcaccgccgacgtcggctgggtcaccggccacacttatatcgtctatggcccgctggccaatggcgcgaccaccgtgctgttcgagggcgtgccgaactacccggacgtgacccgcgtggcgaagatcgtcgacaagcacaaggtcaatatcctctacaccgcgccgaccgcgatccgcgccatgatggcctcgggtaacgccgcctgcgcaggcgccgatggcagcagcctgcgcctgctgggttcggtgggtgagccgatcaacccggaagcctgggactggtactacaagaatgtcggtcaatcccgttgcccgatcgtcgatacctggtggcagaccgagaccggcgccaccctgatgagcccgctgccgggcgcccatgccctcaagccgggttcggcggcgcgtccgttctttggcgtggtgccggcgctggtggacaacctgggcaacattatcgagggcgccgccgaaggcaacctggtgatcctcgattcgtggccaggccaggcgcgcaccctgtatggcgaccacgatcgtttcgtcgatacctacttcaagacgttccgtggcatgtacttcaccggtgacggtgcccgtcgcgatgaagacggctactggtggatcaccgggcgtgtggacgatgtgctcaacgtctccggccaccgcatggggaccgccgagatcgaaagcgcgatggtcgctcacccgaaagtcgccgaagcggcggtggtcggtgtgccccatgacatcaaggggcagggcatctatgtctacgtcaccctcaacggtggcgaagaaccgagcgaagcattgcgcctggagctgaagaactgggtgcgcaaggagatcggtccgatcgcctcgccggatgtcatccagtgggcgccaggcctgccgaagacccgttccgggaagatcatgcgccgtatcctgcgcaagatcgccacggcggagtacgacagccttggggatatttccaccctggctgacccgggtgtggtgcagcatctggtcgatacccacaagaccatgaacgtcgcctgagacggacctgtgtcagcgaaagccccgcccggccttgtgccgggcggggcttttttgtgagcgctatcgggggaggggcttctgtagccgctgccgaaggctgcgatcggctccgcaggagacgcgctcttgaaggccctgaaaggcccttcgggccttatcgcagcctgcggcagcggctacaggcagcggcttttcgatcgaataaatatcggtatgtccatcaggcgtatctgaatgttaccggcgggagggaatgtgtaacccgctgcccggattcggggcaatgagaaacgccaagccctgtttcagggcctttgcggggtcggtaaaaaataagtcataacgctgcgcttgccggaatagaaggctttgcgaataataggcccgcaatttgcaacacagattggtttaccgtcttttgctcttgcataaatctgaagagctgtcaatgtgctcgacctggtttctcagtgcttctgtaatttgttgtcgcattgaggaaatatcggcttcgggcctgtcgttagaatgccgatcactcgctcgtcgttgcctgcccgggagcccgcatggggttcgtggccaggtcctcaaggacgcagcaccgctatcaggttccacccattcgcatattgggctgtcgctcactctgccgttttcgccctttaccgatggagtcctaagatgaagaaactcgtgcttcttggcgccctggcactgtcctccgtactttccctgccgacgttcgccgatgaaaagcctctgaaaattggtatcgaagcggcttaccctccattcgcctccaaggctccggacggcagcatcgtcggtttcgactacgacatcggcaacgccctgtgcgaagaaatgaaggtcaagtgcgtatgggtcgagcaggagttcgacggcctgatccctgcgctcaaggtgcgcaagatcgatgcgatcctgtcgtccatgtcgatcaccgacgaccgcaagaagtccgtggacttcaccggcaagtactacaacacccctgcgcgcctggtcatgaaggccggtacccaggtcagcgatggcctgaccgagctcaagggcaagaacatcggcgtgcagcgcggttcgatccacgagcgtttcgcccgtgaagtgctggctccgctgggtgccgagatcaagccatatggctcgcagaacgagatctacctggacgtggcggccggtcgcctcgacggcaccgtggcagacgctaccctgctgaatgacggcttcctgaaaaccgacgccggcaaaggcttcgcgttcgtcggcccggcgttcaccgacagcaaatacttcggcgacggcgtgggtatcgccgtacgcaaaggcgatgcgttgaaagacaagatcaccggtgcgatcgccgccattcgcgagaacggcaagtacaagcaaatccaggacaagtacttcgatttcgacatttacggccagtaaatcgtcgaatcagcaagtccgagatggcgcaagcagcagaatctctgaagtttgcgccattttttcatcccaattttcgaggacctgaatcatgttgaaaggctacggggctgtcatcctcgatggcgcttggctgacgcttcagcttgccttgtcgtccatggccctggccatcgttctgggtctgatcggggtcgcgctgcgtctctcgccggtgcgctggctggcgtggctgggcgacctgtattccacggtgatccgcgggattcccgacctggtgctgatcctgctgatcttctacggcggccaggacctgctcaaccgtgtcgcgccaatgctgggttacgacgactacatcgatctgaacccgctggctgccggtatcggcaccctgggcttcatcttcggtgcctacctgtcggagaccttccgcggtgccttcatggcgattcccaaggggcaggcggaggcgggcatggcctatggcatgaacagcttccaggtgttcttccgggtgctggtgcctcagatgatccgtctggcgattccgggctttaccaacaactggctggtactgaccaaggccaccgcgctgatttcggtggtgggcctgcaagacatgatgttcaaggccaagcaggcggctgacgctacccgcgagcctttcaccttcttcctcgcggtggcggcgatgtacctggtgatcaccagtgtctcgttgctggcattgcgtcaccttgagaagcgctactcggtaggcgtaagggcggctgatctatgatcttcgactacaacgtcatctatgaggccttgccgctgtatttcagcggcttgctgaccaccctgaaactcttggccctgtcgctgttcttcggcctgctggcggcgctgcccctggggttgatgcgggtgtccaagcagccgattgtcaacctcagcgcctggctctacacctatgtgatccgcggcacgccgatgctggtgcaactgttcctgatctactacggcctggcgcagttcgatgtggtgcgcaaaagcttcctctggccttggctgtccagcgcgaccttctgtgcctgcttggcatttgccatcaacaccagcgcctacaccgccgaaatcatcgccggcagcctcaaggccacgccgaacggcgagatcgaagcggccaaggccatgggcatgtcgcgctacaaaatgtatgcccgcatcctgctgccgtcggccttgcgccgggcactgccgcagtacagcaatgaagtgatcatgatgctgcagaccaccagcctggcctccatcgtgaccctgatcgatatcaccggtgcggcccgtacggtcaacgcgcagtactacctgccgttcgaggcctacatcaccgccggcgtgttctacctgtgcctgacctttatcctggtgcgcctgttcaagctggccgaaggccgctggctgcgttacctggcgccgcggaagcattgatatggaacgcattgaccacccattaccgtggagccacctgggcagcgaacggcagatctcggtattccgtttcggccatggcgagcgcaaggcctatatccaggccagcctgcatgcggacgaactgcccgggatgcgcaccgcctgggagctgaaaaagcgcctgaccgaactggaagcccggggcgcgctgaacggcgtgatcgaactggtgccggtggccaacccgatgggcctggggcagctgttgcagggcaatcaccaggggcggttcgaggccggcagcggcaagaatttcaatcgggattttgtcgagctgagtgtgccggtcgcggcccgcctggaagggtgcttgggggatgatccgcacgccaatatccaggtgattcgccaggccatgaatgatgtgctggccgaactgccggcgccatcgagccaactgcaaggcatgcagcgcattctcctgagtcatgcctgcaccgcggatgtggtgctggatctgcattgcgatgcggaggcggcgctgcatatgtacgccttgccgcagcattggccgcagtggcgttcgctggcggctcatctgaacgtacgggtcggcctgctggcggaagactccggcggcagctcgttcgacgaggcctgttcgctgccctggctgcgcctgtcgcgccagttcccgcaggcgcagattccgctggcctgcctggcgaccacccttgaactgggcggtcaggccgacaccggtcgcccgcaagccgaggcgcacgccgaaggcatcctggcattcctcgccgagcaggggctgatcgcgggcgaatggccggcgccgcagcatgaagcgtgcgaggccatgcctttcgaaggcaccgaattgttgtttgcgccgcatcccggcgtggtgagttttctgcgtccggccggtagctgggtggagaagggcgagccgatttttgaagtgattgatcccttatccgatcgggtcagcaccctgtgtgctggcaccagcggcgtgttgttcgccgttgagcggctgcgttacgcccaacccggtttctggctggccaaggtggcggggcgcgaagcgctgcggcacgggcgcttgctcaacgactgactgcttttgtgagaaccgacagcatgtacaaacttgaagtccaagacctgcataaacgctatggcagtcacgaagtgctcaagggcgtgtccctgaaagcggcggctggcgatgtgatcagcatcatcggctccagtggctccggcaaatccaccttcctgcgctgcatcaacctgctggagcagccgcacgccggcaagatcctgctgaacaacgaagagttgaagctggtggcgaacaaggacggcgccctgaaggcggcggatccaaaacagttgcagcgcatgcgttcgcgcctgtcgatggtgttccagcacttcaacctgtggtcgcacatgaccgccatcgaaaacatcatggaagcgccggtgcatgtgctcggcgtacccaaggccgaagcccgtgcaaaggccgagcactacctggccaaggtcggcgtggcgcatcgcaaggatgcctacccgggccacatgtccggcggtgagcagcagcgcgtggcgatcgcccgggcgctggcgatggagcctgaggtcatgctgttcgacgaacccacttcggcgctcgaccccgagctggtgggcgacgtgctgaaagtgatgcaggccctggcccaggaaggccggaccatggtggtggtgacccacgaaatgggctttgcccgtgaagtctcgaaccagctgatattcctgcacaagggcctggtggaagagagcggcaacccgcgcgaagtgctggtcaatccgcaatcggaacgtttgcaacaattcctctcgggcagcctgaagtaaatcgctcccgtaatgcacccaattaggtcatgctgcgcaccgcgcgccagatggtctaatttggttgcagccgcctttggcctctaacactgttttcgtttcggattgcccgccatgactgcccatcgaattggtttcctgatttggcccagcactaaagccttgacgctggcgctggccgaggaggccttgcgtgtcgctcagcgcgtgcatccggaagtggtctacgaactggccttcctgcaggccgaggcgccggccgacggtgcctggcaactgccgggcgaaccttggtcgggcaagctcgaaggctgccagaaactgttcctgctggccgatgagccgcctgccaccctggcgccggccctgagcagcgcgctcaagcaactggtgcgtgccggctgtgtgatcggtggtttgtctgccggtgtgtatcccctggcgcagctggggcttctcgacggttatcgggcggcggtgcactggcgctggcaggacgatttcgccgagcgcttccccaaggtcatcgccaccagccatctgttcgattgggatcgcgatcgcctgacggcctgcggcgggatgtcggtgctggatctgttgctggcggtgctggcccgtgaccacggcgcggaattggccggcgcggtctcggaagagctggtggtcgagcggattcgtgaaggcggcgagcgccaacgcattccgttgcagaaccgcctgggttccagccacccgaagctgacccaggcggtgctgctgatggaggccaatatcgaggagccgctgaccaccgacgaaatcgcccagcatgtgtgcgtctcgcgtcggcaactggagcggatcttcaagcaatacctcaatcgtgtgccgagccagtactacctggagctgcgcctgaacaaggcgcggcagatgctgatgcagaccagcaaatcgatcatccagatcggcctgtcctgcggtttctcctcggggccgcatttctccagcgcctaccgcaacttcttcggcgccacgccgcgggaagaccgcaaccagcggcgcagcagcagcccgttcgaactgtcttcggtgccttccgagcgcggttgatccgtctctttcgtttacctgtcagattgctatcgcgagcaagcttcgctcctgcacaagaatgcatttctttgcggggcgaagcttgctcgcgatggcgccgcaatgtgtggcgcaaatcgttggacaatcctgccgttaaagcctccagcagtttaaactgcgcctttgcgacgctatttgtcgcattgccgtaaacccgcgtaaaaccggggttggcgctataagaagttgtcgcttggcgacaaggccgggcagaaaactgtccttacaatccccccatcgctcgccagtttcaggcaggcgttcctcttcaggagactccgatgtccgttgagcaagctccggtgcaacgcgccgatttcgatcaggtcatggttcccaactatgcacctgcggctttcattcctgtgcgtggcgcgggctcccgagtctgggatcagtcgggccgagagctgatcgactttgccggcgggatcgcggtcaacgtactgggccacgcccatccggcgctggtcgcggcgctgaccgagcaggccaacaagctgtggcacgtatccaacgtcttcaccaacgagccggccctgcgcctggcccacaaattggtcgacgccacctttgccgagcgtgcgttcttctgcaactccggggccgaggccaacgaggccgccttcaagctggcccgtcgtgtcgctttcgaccgtttcggcgcggaaaaatacgaaatcatcgcggccctcaacagcttccacggtcgtaccctgttcaccgtgaacgtcggcggccagtcgaaatactccgatggcttcggtcctaaaatcaccggtatcacccacgttccctacaacgatctggcggcattgaaagcggcgatttcggacaagacctgcgcggtggtactggagccgatccagggcgaaggtggtgtattgccggccgagcaggcttacctgcaaggcgcccgcgagctgtgcgacgcgcacaacgcgctgctggtgttcgacgaagtgcagaccggcatgggccgcagcggcgagctgttcgcctatatgcactacggcgtgaccccggacatcctgaccagcgccaagagcctgggcggcggtttcccgatcgccgcgatgctgaccaccgaggcgctggccaagcacctggtggttggcacccacggcaccacctacggcggcaacccgctggcatgcgcagtggccggcgcggtgatcgacgtgatcaacacgcccgaagtgctgaacggcgtgaaggccaagcacgatcgcttcaagacccgtctgctgcagatcggtgagaagtacggcctgttcaccgaagtgcgtggcctgggcctgctgctcggttgcgtgctcagcgatgcctggaaaggcaaggccaaggatgtgttcaacgccgctgaaaaagaaaacctgatgatcctccaggctggcccggacgtggtgcgtttcgccccgagcctggtggtcgaggaagcggacatcgaagaaggcctgcagcgcttcgagcgtgcggtcgccaagctgacccaggcctgattcgggccgcggtacttctcggcgcttgtctgcagggcaagcgtcgagcccaattttcggtgccgggctgtcccggcatttttttccctgagtcggcctcctggccggcctgtttcgagtaaggagtgacaccatgctggtgatgcgccccgcgcaaatggctgatctgggcgaggtacagcgtctggctgcggacagcccgattggtgtcacttccttgccggatgacgtggaacgcctgagcgacaagatcgccgcaagcgaggcttcgttcgccgccgaggtgagcttcaatggcgaggaaagctacttcttcgtcctcgaagacaccgaaaccggcaagctggtcggttgctcggccatcgtcgcctcggccggttattccgagccgttctacagcttccgtaacgagaccttcgtgcacgcctcccgcgagctgaagatccacaacaagatccacgtgctttcccagtgccacgacctgaccggcaacagcctgctgaccagcttctatgtggtcccggagctggtgggctcgccgtggtcggaactcaactcccgcggccgcctgctgttcgtcgccagccacccggagcgtttcgccgattcggtggtgaccgagatcgtcggctacagcgacgagaatggcgactcgccgttctgggacgccatcggccgcaacttcttcgacctcaactacgccgccgccgagcgtctgtgcgggctgaaaagccgcaccttcctcgccgagctgatgccgcattacccgatctatgtgccgctgttgccggatgcggcgcaggaagccatgggccaggtgcatccgcgggcgcagatcaccttcgacatcctgatgcgcgaaggcttcgagaccgaccattacattgacatcttcgacggtggcccgaccctgcacgcccgggtctcggggatccgctcgatcgcccagagccgcgtggtgccggtgaagatcggcgaggtcgccaagggcggcggacgccagtacctggtcgccaatgcgcagttgcaggattaccgcgcggtgatgctggagctggattacgcgccgggcaagccggtgaccctggatctgcaagcggccgaagccctgggcgtcggcgaaggtgccagcgtgcgcctggtggcggtttaacggctgcggcaaatgccggaagaatcctggaaagcagcgagtttcgcgggggccgtcagcggcgcccgtctgaggagatagcatgatcgttcgtcccgtacgcagcagcgacttacccgctctgatcgacctggcccgcagcaccggcaccggccttaccaccttgccggccaacgaagagcgcctgaaacaccgcgtgggctgggcggaaaagaccttccgtggcgaagccgagcggggcgatgcggattacctgttcgtgctcgaggacgacaacgggcgcgtggtggggatttccgcgatcgccggcgccgttggcctgcgcgagccctggtacaacttccgggtcggcctgaccgtcagcgcttcccaggagctgaacatctaccgtgagattccgacgctgttcctggccaacgacctgaccggcaattccgagctgtgctcgctgttcctgcatgccgattaccgcactggcctcaacggccgcatgctggccaaggcacgcctgctgttcatcgccgaattcccgcagctgttcggcaacaagatcatcgccgagatgcgcggcatgtccgatgaagccgggcgctcgccattctgggaaagcctgggccggcacttcttcaagatggaattcagccaggccgactacctgaccggcgtcggtaacaaggcgttcatcgccgaactgatgccgaagttcccgctgtacacctgcttcctctccgagggcgcgcgcaacgtgatcggcaaggtgcacaccgataccgagccagcgctggccatgctcaagagcgagggcttcagctaccagggttacgtcgacatcttcgacgccggcccggcggtggagtgcgaaaccgccaagatccgcgcggtgcgcgatagccaggcgctggtgttggccatcggcacgccgggcgacgacgccacgcctttcctgattcacaaccgcaagcgcgaggactgccggatcaccgcggcacccgcgcgctttgcgtcgggcaccctggtggttgatgcgctgaccgccaaacgcctgcaactcaatgcgggcgatcaggtccgtgccgttgcgctgtctgcttcccgggagtcgaaataatgaacacgctgtacatcgcaggccaatggctgccaggtcagggcgaagcctttgaatccttgaatccggtgacccagcaggtgctgtggtcgggcaacggcgccaccgtcgcccaggttgaaagcgcagtgcaggccgcgcgccaggcattcccggcctgggccaagcgttcgctggacgagcggatcgcggtgctggaagcctttgccgtcagcctgaaaagccatgccgacgaactggcgcgctgcatcggcgaggaaaccggcaagccgctgtgggaagccgctaccgaagtgaccagcatggtcaacaagatcgcgatttcggtgcagagctaccgtgaacgtaccggcgagaagagcggcccgctgggcgacgccaccgcggtattgcggcataagccccacggtgtggtggcggtgttcggtccctacaacttcccaggccatctgcctaacgggcatatcgttcctgcgctgctggcgggtaacagcgtgctgttcaagcccagcgagctgaccccgaaagtcgccgagctgaccgtcaagtgctggatcgaagccggcctgccggcgggcgttctgaacctgctgcaaggtgcgcgggaaaccggcatcgccctggctgccaacccggggatcgacggtctgttcttcaccggttccagtcgcaccggcaatcacctgcaccagcagttcgccggccgcccggacaagatcctcgcgctggagatgggcggcaacaatccgctggtggtggaccaggtcgcggacctggacgcggcggtctacaccatcatccagtcggccttcatttccgccggccagcgttgcacctgcgcccgccgcctgctggtgccgcaaggcgcctggggcgaccagttgctggagcgcctggtggcggtcagctcgaccatcgaggtcggtgccttcgaccagcagccggcgccgttcatgggctcggtgatttcccttggcgcggcccgcgcgctgatacaggcccaggaaaacctgttggccaatggcgccgtggcgctgctggaaatgacccagccgcaggcccaggccgcgctgctgaccccgggcattctcgacgtgaccgccgtggccgagcgcccggacgaagaactgttcggccccttgctgcaagtgattcgctacgccgatttcgaagcggcgatcgccgaggccaacgacacccaatacggcctggcagcgggcctgctgtcggattccgaggcgcgttaccagcagttctggctggaaagccgggccggtatcgtcaactggaacaagcagctgaccggtgccgcgagcagcgcgccgttcggcggtgtgggtgcctcgggcaaccatcgcgccagcgcctattacgcggcggattactgcgcgtacccggtggcgtcgctggaaaccgcgagcctgaccttgccgagcgcgctgacgccgggtgtacgcctggggtgatgggttgcgccgcagattgcggaaaggtcccgcggaccttatcgcagcctgcgaagcggctacagagagcggcggggcgtcggtggttgtggtaaccctgtggccgcgccgcaggctgcgatcgtcccgcgaagcgggcgccgacggcctcaagacatgtactgataccgatgcctataacaacagattctcgtggagcctcgctgatgaaatcctatgaagtcaatttcgacggtctagtggggcctacccataactacggcggcctgtcctacggcaacgtcgcgtcccagagcaacagccagcagtcttccaaccccagggaagccgcgctgcagggcctggcgaaaatgaaagcgctgatggaaatgggtttccagcaaggcgtgctggcgccacaggaacgcccggacgtggccgccctgcggcggctgggttttgccggcagcgatgcacaggtcatcgagcgcgccgccaaggacgcgatgccgctgctggtcgccagttgctcggcgtcgagtatgtgggtggccaacgccgccacggtcagcccgagcgccgacacccgcgacggtcgcgtgcatttcaccgccgccaacctgaactgcaaataccaccgcagcatcgagcacccgaccaccagtcgcgtgctgggggcgatgttcgccgaccagaaacacttcgcccatcacgcggcgttgccggcggtggcgcagttcggcgatgagggcgcggccaaccacacccgtttctgccgtgactacggccaggccggtgtcgagttcttcgtcttcgggcgcagcgccttcgatacccgctacccggcaccgcagaagtacccggcgcgccagaccctggaagcctcgcaggccgtcgcccgcctgcacggcctgagcgacgacggtgtggtgtatgcccagcagaacccgtcggtgatcgaccagggtgtgttccataacgacgtgatcgcggtgggtaacggcgaggtgctgttctaccatgaggacgcattcctcgagaccgacaagatgctcgccgagctgcaggccaagctgggcaagtgtggcggcaacttccagtcgatctgcgtgccgcgctcgcaggtcacggtggaagacgcggtgcgttcctacctgttcaacagccagctgctgtcccgcgccgatggctcgatgctgctgatcgtgccggaagagtgccgcggcaacgagcgtgtctggcagtacctgcaaagcctgaccagctccggcggcctgatccgcgaagtgaaagtcttcgacctcaagcagagcatgcagaacggcggtggcccggcgtgcctgcggctacgggtcgcgctcaatcaaaccgagctggcggcggtcaacccaggggttatcatgactgtgccgttgtacgacacgctgacccaatgggtcgacaagcactaccgcgaccgcctcagcgagaacgatctggcggacccgcaattgctgcttgagtgccggacggcactggatgaactgacgcaaatccttaaactgggcgcggtttatccattccagatcaattaaaagcccgcgcctgcttctgctgatccaggcgcgccgctttacctccagatgagagcgtaataaatgagcgataccctgcagctgatccttgaagacaccgacggcactcaactggaaacttcctgcacccgcgttgccgtgatgtggcaaggcaaggaactgtggatccagcaggacggccgcggccagctgctgatcggcgtggacgtcgaggaaggcgacgaagaatacgccaacctgctgctgcgcccattggcgactaatctggtaagtctgcaactggaaatggaaccggccgacgcgggtgacgatgatcacgtgcacggccctgactgccagcacgaccattaaggaataacgttctatgctcgccctcggcaaactgcttgaactgaccctcgccggtcgtgaaccggcggagaagactcaactgactgtcgacggcgtgcggatgcgctggctgagcgaaggtgcgctggaagtccggccaccccaggcgcgcgacaatggcatggatgtgctgttgtcggccggcatccacggtaacgagacggcaccgatcgaattgctcgaccgtctgttgcatgacatcgcccgcggcgacctcaagccgtgcgcacgcattctgttcctgttcggcaatcccgaggccatgcgccgcggcgagcgtttcatcgagcaggacatcaaccggctgttcaacggccgtcatgaacaaagcagcggcaacgaagcactgcgcgcctgtgagctggagcgcctggcggcgagtttcttcagcctgccggagcgtacccgcctgcactacgacctgcacacggcgatccgcggttcgaagatcgagcagttcgccctgtatccgtggaaggaaggtcgccagcactcgcgccgggaactggcgcgcctgcgggccgcgggcatgcaggcggtgctgctgcagaacaaaccgtccatcgtgttcagctcctatacctacgacaagctggacgccgagtctttcaccctggaactgggcaaggcccggccgttcgggcagaaccagggggtgaatgtcgagcgtctggaaacccgcctcaagcagatcatcgaaggccgcgaaccgcccatggcggaggagaagctggatggtttgcagctgttcagcgtcgctcgggaaatcatcaagcacagcgataccttccacctgcatctgccggcggacatcgagaacttctccgaactggaagtgggttacctgctggccgacgacatcgcccagacccgctggatagtcgaggaggagggcgcgcggatcattttccccaaccccaaggtgaagaacggcctgcgtgccgggatcctgatcgtgccgaccactgctgacggtctggcctgacctgtagccgctgccgaaggctgcgatcgaccgcgtagcgggcgccgcttttgaggttaattagaaggccctgcgggccttatcgcagcctgcggcagcggccacaaaaaaacatcgcgagccagctcgatccctgtaggaacgaactggctcgcgattttgctttcagcgtctgacgcttacaccgctacccgctgttcaggacgacgcagggcgcgagtcttgtgcagggtgtcggcgcagatcttcgcggcttcctggcccttgtgtacgaaatgctcgaagaagaacttctgatgttcttcgccggcgtggaagtggtgcggggtcaagaccaccgagaacaccggcacttcggtttccagctggacctgcatcaggccactgatcaccgactgggcgacgaactcatgacggtagataccgccgtccaccaccaggcccgcggcaacgatgccggcataacgaccggacttggccagcagcttggcgtgcagtggaatttcaaaggcgccgccaacttcgaagaagtcgatatcactttcctgataaccctgggcgagcatttcgctgacgaaccctttgcggctctggtcgacgatttccttgtgccagcaggcctggataaacgccacgcgttcgccgtgatgctgtttgcttttgctatcgattgcggtgggttgcattggttctgactcctgtttgtgtgaaaaacagggcgttatgaatcgaaagggatttaagggtacgtacaggccaggcgcacaagcagtcatgcgaaggtctgtggacggccctttggcgccaatcccgttctctcttcatccggactatgaccgtcggccccgggatcacaccgggtctgctgaccttgccgtcattggccgccgaagcggtgcctgtcgccaagcgctcgcgggctatgcgcattgcgcgcaattaccgccggtggggaattacaccccgccctgagaacgttgccaccgggctttgcggcggcggtgagtttgtaacacatatttttcggcggtgcattgcggcgtttggatgataaacatcggtttttcatgtccatcgctgggcttttcccgggcgggccttgataaatcacggttgtgcccgtagtaattcagttcgaaagaatttccttatccgcagcgacgttcgcgtccccttgccgaggcctgattcatgagcgttatcgatcttcgtagtgacaccgttacccaacccacggcaggcatgctggaagcaatggccacggcggccacgggcgatgatgtctacggcgaagatccgacggtcaaccgcctggaagctgaactggcgcagcgcctggggttcgccgaggcgctgttcgtgccgaccggcaccatgagcaacctgctgggcttgatggcccattgtgggcgtggcgacgaatacatcgtcggccagcaggcgcatacctataagtacgagggcggcggcgcggcggtgctgggttcgatccagccacagccactggaagtacaggccgacggctcgctggacctggcccaggtggccgcggcgatcaagccggatgatttccactttgcccgtacccgcctgctggcgctggaaaacaccatgcagggcaaggtgctgccattgagctatctggcgcaggctcgggccttcacccgtgagcatggcctggccctgcacctggacggcgcgcggctgtacaacgcggcggtcaagctgggcgtcgatgcgcggcagattacccagcacttcgactcggtctcggtgtgcctgtccaagggcctgggcgcgccggtgggctcggtgctgtgtggttcggcgcagctgatcggcagggccaggcgcctgcgcaagatggtcggcggtggcatgcgccaggccggaatcctggccgcggcgggcctgtacgcgctcgatcatcacgtagcgcgcctggccgatgaccacgccaatgcccaactgctggccgaggggctgcgtgaagcgggctatgacgtcgagccggtgcagagcaacatggtctatgtcgcgatgggcgacagggcagaagcgctcaaggccttcgccggcgagcgcgggatcaagttgagcgccgcgtcgcggctgcggatggtcacccatatggacgtcagtcgtgcacaaatcgagcaggtcgtcgggacttttatcgatttttcccgcaactgacagtgttagccgtccaattgaccgtctctatcgtataaacacgctgtaccccaagctcagggccgatataatgcggccctttgccgtcgtttcgtctgatgacgtttcgcacaggcctttggccgcagtctccgtggaagaacctaatgaaaagcgcagaaatccgtgaagccttccttcgcttcttcgaagagcaaggccacacccgtgtagcctccagctctttgattccgggcaacgacccaaccctgctgttcaccaacgcggggatgaaccagttcaaggactgcttcctgggccaggaaaagcgcgcctatacccgcgccgtaagcagccagaaatgcgtacgcgccggcggcaagcacaacgacctggaaaacgtcggttacaccgcccgtcaccacactttcttcgaaatgctgggcaacttcagtttcggcgattacttcaagcgtgacgccatcaccttcgcctggactttcctgacctccgacaagtggctgaacctgccgaaagagaagctctgggtcaccgtctacgccagcgatgacgaggcctatgacatctggaccaaggaagtcggggttccggccgagcgcatggtccgtatcggcgacaacaagggcgcgccatacgcctccgacaacttctggaccatgggcgataccggcccgtgcggtccttgcaccgagattttctacgatcacggcgccgatatctggggcggcccaccgggctcgccggaagaggatggcgaccgttacatcgagatctggaacaacgtattcatgcagttcaaccgcaccgccgatggcgtgttgcatccgttgccagcgccgtcggtggacaccggcatgggcctggagcggatcagtgcggtcctgcagcacgttcactcgaactatgaaatcgacctgttccagagcctgctgaacgcggcggccaaggccatcggttgcaccaacgacgcccaggcgtctttgaaagtcgtggccgaccacatccgttcctgcggcttcctgattgccgacggcgtgctgccttccaacgaaggccgcggttatgtcctgcgtcgcatcattcgccgcgcttgccgtcacggcaacaagctgggcgccaagggcagcttcttctatcagatcgtggctgccctggttgccgaaatgggcgaagccttcccggaactgaaatcccagcaggcacacatcgagcgcgtgctgaaagccgaagaagagcagttcgccaagaccctggagcagggcctgaagatcctcgagcaggacctggccgaactcaaaggcacggtggtaccgggcgacgtggtgttcaaactgtatgacacctacgggttcccgatggacctgactggcgacatcgcccgtgagcgtgaactgaccctcgacgaggaaggtttcgagcgcgagatggaagcccagcgcgtacgtgcccgttccgccagctccttcggcatggactacaacagcctggtcaaggtcgatgtggccaccgaattcaccggttatcacgccaccagtggttcggccaaggtggttgctctttataaggaagggcaatcggtcgacgtgctgagcgaaggcgaagagggcgtggtggttctcgaccagacgcctttctacgccgagtcgggcggccagatcggcgactgcggttacctgcaggcgggtaatgcgcgtttcgacgtgcgcgataccaccaagaccggcggggctttcctgcaccacggcgtcttggccagcggcagcctgaccgttggtgcaccggtgcaaacccaggtggatgccgaagtgcgtcatgccacttcgttgaaccactcggccacccacttgctgcacgccgctctgcgccaggttctgggtgagcatgtacagcagaagggttcgctggtcgacagtcagcgcctgcgtttcgacttcagccatttcgaagcgatcaagcctgagcagatcaaggccctggaagacatcgtcaacgccgagattcgcaagaacaccgcggtggaaaccgaagaaaccgatatcgacaccgccaagcagaagggcgccatggcgctgttcggcgagaagtacggcgacagcgtgcgtgtactgagcatgggcggcgatttctccgtcgaactgtgtggcggtatccacgccaaccgcaccggtgatatcggcctgctgaaaatcatcagcgaaggcggcgtggcctctggcgtacggcgtatcgaagcagtcaccggtgccgcggcactggcgtacctgaacgctgcggaagagcaactcaaggaagcggcgaccctggtcaagggcagccgtgacaacctgatcgacaagctgtcggccgtgctggagcgcaaccgcctgctggagaaacaactcgagcagttgcaggccaaggcggccagtgccgctggcgacgacctgttggcgcaggcgctggatgtcaaaggcgcgaaagtgctggcggcgcgcctggacggccaggacggcaaggcgctgctggcgctggtcgatcagttgaaaaacaaactcggtcgcgcagtgatcctgctcggcagtgtccatgaggaaaaggtcgtactggttgcgggcgtaaccaaggacctgactggccaactcaaagccggtgatttgatgaagcaagccgctgcggcagtgggcgggaagggcggtggtcgtccggacatggcgcagggcggtggtgtcgatgccgctgcgctggatgccgcgctggccctgaccgttccgtttgtcgagcaggggatttaaggttccaagccgagcccgtcgtctagtggcgggctttggagctgcgcagtttgattgattaatgggcgcccctttacgggctgaggcggcttagaaatggctttgatcgtacagaaatttggaggcacctcggtcggttccgtcgaaagaatcgagcaggtcgccgacaaggtgaaaaaattccgcgaagccggtgacgacctggtggttgtactgtcggccatgagcggcgaaaccaaccgtctgatcgaccttgccaagcaaatcagcggcgacggtcagccggttcctcgtgagctggatgtgatcgtttccaccggtgagcaggtgacgatcgcacttttggccatggcgctgatcaagcgcggcgtgccggcagtctcctataccggcaaccaggtgcggattctgaccgatagcgcgcacaataaagcgcgcattttgcagatcgacgatcagaaaattcgcggtgacctgaaggctggtcgcgtggttgtggtcgcaggtttccagggcgtcgacgagcacggcaacatcactaccctcggtcgtggcggttccgacaccaccggcgtggcactggcggcagccctgaaggctgacgaatgtcagatctacaccgatgtcgacggcgtctacaccaccgatccgcgcgtggtgtccgtggcccagcgcctggacaagatcaccttcgaagaaatgctggaaatggccagcctgggttccaaggtgctgcagatccgcgcggtcgagttcgccggcaagtacaacgttccgctgcgcgtactgcacagcttcaaggagggtccgggtaccctcattactattgatgaagaggaatccatggaacagccgatcatttccggcatcgcttttaaccgcgatgaagccaagctgaccatccgtggcgtgccagacactcccggcgtggccttcaagattctcggcccgatcagtgccgcgaatattgaagtcgacatgatcgtgcagaacgtttcgcacgataacaccaccgacttcaccttcactgtgcaccgcaacgattacctggcagcccagcaagtgctggaaaacactgcccgtgaaatcggtgcccgggaagtggtaggcgataccaagatcgccaaggtctcgatcgttggcgttggcatgcgttcccacgcgggtgttgccagccgcatgttcgaagcactggccaaggaaagcatcaacatccagatgatctcgacctcggaaatcaaggtttccgtggtgatcgaagagaagtacctggaactggctgtgcgcgctctgcacacggctttcgaactggacgctccggcccgacagggcgagtgatgcgttgcccgaagggcgcggtttaccgcgccctttgtttttttgatcggcgtgacagaaaactgttcttttgctcgcgctagtcaatacttaggcgtgagggctacggccgtcctggttgtaggtcgatacccttttttttgcagactgttgtccctgaaatgaaatgcgtgaggagaaaggtatgctgattctgactcgtcggtgcgcagaaagcctgattattggtgatggcgaaatcaccgtgaccgtgcttggcgtcaaaggaaatcaagtgcgtatcggtgtcaacgcccctaaagaggtagcggtgcaccgggaagaaatttacctgcggataaagaaagagaaggacgaagaaccaagccattaatttttatcgttttttttgtttgcaaacggggagaaagctggttaatatacgccccgtgttgcggagagctggccgagtggccgaaggcgctcccctgctaagggagtacacctcaaaagggtgtcgggggttcgaatcccccgttctccgccattatttgcttagttcgttgtaatctggcttcttctgtaagttgttgaaattactagaaaaagtgctttacaaaaagatttaacggcctataatgcgcggcaacaaatgcactcgtagctcagctggatagagtactcggctacgaaccgagcggtcacaggttcgaatcctgtcgagtgcaccatttaagagttgtttgcagtaatgtgaataacttggcttcagccagttgtggtctggtctaaaaacacaaattgcactcgtagctcagctggatagagtactcggctacgaaccgagcggtcacaggttcgaatcctgtcgagtgcaccatataccaagaagcccgcatttattgcgggctttttgctttctgccgtttgggttttctcccttctttattggttcctctgtttgaacgtcgcgatcattctggcgtcgtattcagcgtgtgcctgtccttttgatgtggcctttcgaaaactcccggcaattgtgaatcgatagcgggagcgagttccgggcgcagttttttggtctggggtgtgttttctttttcggttggtgcgtcgcagctttatagattcagcgcttcttcagctttgcgccgcaagcgcttgttcttgccatgattttttaacgtttaaagccgtcaagcggtgtatgattgcgcccgtcagccccgccggggcttgtggaatacctccatggacttacccagtagttactcagtatcccgtttttacaatcatgaattgactgattgatccttccggcgtgctcctctgctgggagtggagttcgcctatgaccgaagtagaagtaaagaaaacacaagacagcctgcaggatcgcctcgctcaagtcgttgagctgctgcagcgccagcgggtggtcgaagacctgactcatcgtcaggaaggtcatcatcaggatcgggtcgagaacctggtccaccggcaaaaccttgtcgagctgcaacgcaagctcgacgatctgcactctgccgacgttgcctacatccttgaagccttgccgctcgacgagcgtctgactgtctggcagttggtcaaggccgagcgtgacggcgacatcctgctcgaagtatccgattccgtacgtgaaaccctgatcgccgacatggacgatcatgagctcctggctgctgccaaggagatggacgctgacgaacttgctgacctggctcccgagctgccgcgagacgttgtccatgagctgatggaagcgttggacggccagcagcgcgagcgcgttcgctccgccttgtcgtatgacgaggagcaggtcggtgcgttgatggacttcgagatggtgaccatccgtgaggatgtcagccttgaagtggttctgcgttatctgcgtcgcctcaaagagttgccaggccataccgacaaactgttcgtcgtcgactatgatggcgtgctcaagggtgtgctgcccatcaagcggttgctggtgaatgatccggagaaacaggtttcggaagtcatggccagcgacccggtaagtttccatccggacgaagatgcctacgacgctgcgcaggcattcgagcgctacgacttgatctcggcgccggtggtcgacaagaacggcaaattgatcggccgtctgaccatcgatgaaatggtcgacctgattcgtgaggagagcgagaccgaagtcctcaacatggccggtctgcgtgaagaagaagacatttttgcctcggtctggcgttccctgcgcaaccgctgggcctggctggcaatcaacctgatcaccgcatttgtcgcttcgcgagtgatcggtctgtttgaaggttccatcgaaaagctggtggccctggcggccctgatgccgatcgtggcgggtattggcggcaactcgggtaaccagaccatcaccatgatcgttcgcgccatggcgttggaccaggtcagcaccggcaatacctcgcgtctgatgcgcaaggagctggcggtggccttgatcaacggcctggtctggggcggagtcatcggtgtggtggcttacctgctctacggcagttggtcgttgggtgtggtgatgacggcggccatgacgctcaacctgttgctggcggcgctgatgggggttctgattccgatgacgctggcgcgcctggggcgcgacccagccatgggagccagcgtcatgatcacggccatgaccgacagtggcggcttctttatcttccttgggctggccaccatcttcctgctttgatcccgcatacagcccctctaatggggctgtatcgttttctccatccccttgccatccagacttctgtgttttgtaacgttcgagcagcaaatttcgcgcaaaaaaagccagcacaaggctggctctagctttcgaggtcgaatcaggaagcgtctgcggccatttcggcgtcatgggcgatcagcgaaacgagagcgttctgctggcggtgggaaagttgacggaagcgttgaagcagttcgcgttcatgcaaggagagttctgggctgtccaggcgcatgctcaactcttcacccaaggcgccttcctgaataagactctgttccaagcgcgcgatgatttcggagttcatgctgcggtgatgattgcgagccacctcggcaatgcgttcacgcatcccgtcgggtagacgtacgacgaacttgtcagccgtacggctggaataaattgcctgtttcaatgggcgcatatatttaaccggttagttcaggggagcggttctcggaattggccgcgggatgtcagttaggacaagcgttgctgccaaatgttcaacctgaattgttaagaggcccgcatcatgcctcaagatagccagatccttggcgtcaattctgtgacaaatgttgaactgggtaaaggcgttatgccagcaccaattatcagaaatgcggactggtttgaaaagattgcctgctccgcctatctgcccgcgtcctgatgtccgatggtggtgcgcttgtgcgtcgccagacgggcatgcatgcggatccgatcattgtttcctaccttgtacaggatagtggcaaattgccgatttactaggctgtgagtgccatggagtctttgaatgccaggcagactgatttatttgatggggccttccggatcgggaaaggacagcctgatcgaggctgcgcgtcggcctctggcgcagctcggctgcgatgtggtgcggcgggtgatcacccgttccgcggaatccgtgggggaggaggctcacggggtaagtgctgacgagttcgagcgcctggaacggcaggatgcctttgccttgtgctggcgggccaatggcctggcctacggaattcccgtgcagatagacgaatggctggccagtgggcgtcatgtcctgatcaatggctcaagagctcacctggatcaggctcgccagcgttatccggagcttttggcgattctattgacggtggacatcgacgtgctgcggcaaagattgatgaaccgtggtcgcgaaagcgcggcgcagatcgaggcgaggctcaagagaagcgctcttttttccactgagggcgggcctgtgctgggagagtccgtattttttctggacaactcgagcgagctgtccgtgacgcttgagcgttttctgaagttattgagatcgcaggggatcagcgcaatacagggtcgaacttgattttacgtcctaacaccagcgccagcaggaacaggccggaaaaaacaccacaggcaaccaggggcgcatcacccagagtattttcagtggtgaagcaactcagtgtggcactgagtattgccaggatgagaaggcctttggcaagtcgggacattaacaggctcctgatgggtgatattcaaaatacccagctttcgggtcttggattggcaggtagaacaacggcttctggggcatcggcgacctgtgccatgccaggattctccgatgcgctgctcatcacagccaattgcggggcctggtgttgcacgtagtgggccctgtactgggtggtactctgatccgcgcggccatcaggctgaaagtggaagaccaccaggacggtgatggcaatggcattcgatagaagaagggcgctgttcatgggcttgatctccactgttctttcatggagaggaagcagcgctcatgccaagagtctaacctctaataaaccctttcaaaacaatgatttattagggtttttgtaaggcagtggattgcattctgcaatgatggctttttgcagtgatgcaatttgcacggcggctctggcaagttgcctgatggtcagaggccgccaccggttaaaaagccctactcacaacatgacaaaagcagggctggccgttaacatgcacgccgtcctttgcgccgcggcagtacacgcggtggtcaatttgtcccagtagctcaattggatagagcatccccctcctaaggggaaggttggcagttcgaacctgccctgggacaccatctatttccgggctttcaggccaaacatggttttcgtctttatttcctggtaacgctacgtttggtacacgcagttctcgatgctgtggagtcacccatgattgtcattgctggaaaaaacaatatttcggtatttggcctggaacgggctttgcgacaattttcgcccgatgaaattgtcgtggtctgcaaccgtaacgatacgggcgtcgatggttggcaacgttcgttgcgggcggccgcgcagaaagtatggcgtgcgtgagatcagcctggaggcggcttatgaagtcgcgtccaccgcattcatttccctggagttcgaccggatcgtcgtgccagggcgtttctccatcagtcgtgtgtccaacattcatttctcaaggcttcccgaatacaagggtatgtttacctcggtctggccgttgctggagtccagggccgaggcgggtgtgaccctgcatttcatcgaccggggtattgataccggggagatcgtcgcgcaacaggtatttccgcgtcagagcgcagccacagagtgcagtgggatccagctacttttcaaaggacgccatcgactatggggcgttgaagatcgatccgctgtcgacggcctgggcgctacgcaaccagatcagggcgttcgcctttcgtgaatatcaattcttgcgctgggatggaaaaccggtggtctcggcgacgattctgcccgggcgttcgcaattcaaggccgggaccctgatcagcacaactgacgattatgtcgaactctgcaccatcgattatgacgtccggctgaattttgatcggctgccggagatgctcaaggcttgtgaacgaggcgatctggaggcggtggtggcactgcaggccaatattgccggttacaacgatgccaacccacaaggctggacgccgctgatcgtcgccagttatgcgggtgcctatgaggtggttgactggctgttgcagcaaggtgccgacccggagcggcccaacaacaaaggcacgacgcccttgatgtatgccaaggatgcctacctcaccgggcgttgtcgtaaaacctttcagttgttgctgcgcaagggcgcgaggctgccgaccattgcggtcgggcactcgccgactatgtgactgacgagcagttcgctcagttacgaggtgctttctaggcacttcgcaacaggcgcatcagtgggcggtgaacaggttgatagcggtgacaatatattgctgttgttcctggctcaatgtcgggtagatcggcaatgacaggatcgagtcatgcagcggcgcccgggatgcctgggaggtcctggccagatcgctgtaggcccgctgctcggtgatcgccagtgggtagtgaaccaggcattggatgccacgctcggccagatgcgccttcagctgatcgcgccatgggcaggtaatgacatacaggtgccagacatgggcgctcgcagtcgtcaccgagggcagggtgattcccgggtgccggatgtgttcgccgtagtagcgggcgatgctgcgtcgacgggcagtatcgctgtccaggtgcgccagcttcactccgagcatcgcggcctggatttcatcgaggcggctgttcaccccctgatgatcgtgctggtacttgacgcgcgaaccgtagttgcccagcgcccggaccagggttgccagctcggcgtcgttggtagtgatggcgccgccgtcgcccagggctccgaggttcttcccggggtagaagctgaaagccgcggcatcgccccagttgccggccttgcacccgaccagctcggcgccatgggcctgggcggcatcttcgagcactagcaggccatgcttgtgggccagcgccatgatctgcggcatcggcgacagctgcccataaagatgcaccggcaggatcactcgggttttttccgagatggcccgctcgacggcctcgatctccagattgtgggtggcagggtcgacatctaccaggatcggcgccagatcgttttccagaatggccgagatggtggcgataaaggtgttgctctgcactatcacttcatcaccggcctgcagccggccttgctctttccaggcgcgcaggatcagggtcagggcatccaggccgttagcgacgccgatggcatgccggctgccgcagtaatcggcgaacgcggcctcgaattgctcaagctcacgccccatcaggtaccagccggagtcgatcacacggctgcaagcggctttgagctgatcggcatattcgtgattgatgcctttcaaatccagaaacggaatattcatcatttgagtcattgtccgaccatgtccatgaactgggcatagtctcgaacatagtcgccttcttcatagagttgatcggccaggaccatcagcacacagtctggagagaagtcatacatttcacgccagataaaggattcgatcagcaggccctggcaaggattgtccagggtgatgtcgattttttcccgaccgtcgtccagcaggaaacggcacgagccgcgtacggcgatggccacctgcttgagggtcttatgagcgtggtagccgcggcgaactccttcaccggtattgaacatgtagtacacccgcttcaccgggaaggggatgtttttcccttcttccagggcgatcagcgaaccacggtcatcgccgtgggtctgcagcggcagaatgtgaatcttcatcgcgtctccccttcgagccgtttcgacaaatgctgttgcagccagttttcaacgcgcttggcgtcgacccgataatttcggtaatacagttctcgggagtcggtcgagcccacccggtaagcgatgtagtccatttccacgccgacgatcgccgccaggttggaaaaacatgacagttgcccatactcctcggccatccagcacagcgcgcgggcgtttttcgaggcgaaaatcagattggtccaggccgcgccggtggggccgactatgacttcggcattggccatgatcgccacctgatggctgatgtcctgttcctccatgtacacgcaggtaaacccatagggttccagcagcttgaggatttcggcctggttgtagtgccggagaaaacctttgcgggccaggaatactcgcttggggagtttgccggtggggacgtcatgggccaggcgcagggctttttcccgcaggaagttgatcgattccgggcgtacgaagccgctgctggcactgttctgtgccacgcctttgaagttcgggatcatgttgttgggcgcgctgatcagcagcaggtcggccacttgatagctggtgatgttgtccaggagtaccagcgggcggtcaacgccaatcgcctcgatcagggccttgatcgagggaatgttctggctgctcttggagatcagcagtggatagtccgcatattgcggcggcagttcggccacgaattgcagttgagacaagacttctaccgtccagtggtaatagttctgctcgttacagccgctgatcagcaggcctttgtccagctcgatgggtttgccggtcctgaccagggccaggcgctggccgtggtagagcaggtgcgcagcactatagtcggcctgcgaggactttgccgtgggcactcgctccagcaccaattgcccatttggcagtatcaccgaacgggacaccgaacagacctgcccctggcgaaagtgatagagggcgacctcgggtaattccagggtgatcgccggtgtcgattgatggacgaaccgtggcggctggctgcttcccggttggttcgggagaaacacatggaccttgtgctcggcgctttcatccagccagcgcaaggccaggcgccgggtatcctggcgtcgaaaaagcaggcgatacagcaggtcgctgatcagtcccggctgcttgcacatgcgttcatagcccagttgctccaggcgtttgccaatgcgctggaaccatgagagttgcgagctgatctgtgcgccatggaacacttcgatccgttgttcatcgatcaccagcttgtcggtgagctgcgggtagatctcactgtagtaatcgctggcgatgatgatcttgtcgaaaaccagcgcgctcagttgctgaggggcgtggatcaacttgccgaacagatgctggccctgcttctgctggttgttatcgacgaagccgatcacccggtagcggcggcggttgtacttgtagaaattgatgccgccggcaccggtgccgaatatcagcacccgcgctttctgtccaaaccctgttgacacattgacctcgtcttactggtgcagccgctggtaaatcgtcacccgagcggttcgcccgttcgtttcaagcggtgacgctagccattgttattgatgatgttgcccttgatctgggcgatacccttggcgttcaggtcgcgtcgggtccttaccggttgcaactcaccctggatcgcaccgttgatggtgtcgatcgcggtcttgccggtattgcctcgggacttacccagcagataacgcagtgacaggcggaactgctccgactcgttggccaccggccgtgtgccatgcaaggtgcagttatgccagagcccgacgtaacccggcccgccggtcagccggtaatcctggcaggtcatctgctgcccatgatcgtcggcgtaggtccaccgatcatgctcctgatgttccagtccatgcgggaacagcgtggcgccaaagcggtgagtgccgggcatcaggtgcaggggcgagtcgttttcggtgacgtcgtgcaggtacacgtacagggtcagaaaggtcgaggggtcgagttccactcggccctggggccaatcgatgatgtcctggtggaagtcgatcccgcgaaagtaggtgatgtcgcgaaagggttttttgatatagggccccaggttcgccacattcacatcgcggatcttttcccgcacccagtccggcagccatgagtccggtacgccgcacaccgctttcttgatcaccacctcatagtcggcgccgagcacttcatcgaggactgcagtgaggcgcgggtcctgctcgatgaactgcaactgcgactcgaagccattgaggaagttgaaggtcttgttcgggttggcgttgaggtggttttcctgggccaggtattcagcctcgtccatgaacagccctgccccgaaggcccgtgcggcgatcatttcgcggtacagcgcctgcgtgcggtcagcgtccaggatctcgccgaagatatgggcgccctggtcgatgaggttttggatacaggtttgcatgttgcgctcgttttgactgttgctgtctgtctgcaaggtatcggcgtggctggcttaaagttgatgccgtgcggctgatattcccgatggagttgccgcaaccggagctggcgggcggcgcgagcaaggatatcgaatgcttttggcaactatctataagggaacgccggaatcggccgataaccccatggatgttgttgcaggtcaaatggcggggccatggaccgagtgtccggcgagagcgggcgggcgccattgtaggttgatgtagaatgcattgatggcctgtggccattatcgttgtccgggggcaacaagggggacgaccttgagcgtgtcctgctgttgccgcgggcttcatcttttttacgggtctggaatcttcgatgctggcgtaccaccaaaaaagctttttgatcgtcgatgatttctcggatttccgcagttctgtccggtccatgctgcgtgagctgggcgtcaaggacgtagacactgccgatacaggcgagcaggcgctgcgcatgtgcgcgcaaaagcgttatgacttcatcctgcaggattaccacctgggcgacggtaagaagaatggtcagcaggtgctcgaagacctgatgaccgacaagctgatcagccatgaaagcgtgtttctcatggtcaccgccgagaccagccagtcgatggtgctcagcgccctcgagcacgagccggacgcctatctgaccaagcctttcaaccgctccagcctggctcagcggctggagcggctgcagcagcgcaagtcgttgctcaagccgatcctgcaggcgctcgatcgcggcaagccgctcgaggtgctcaatgcctgcatcgccctgtgcaagcaggatccgcgttattcgccgttgtgcctgcgctaccgggccgatgccctgcgtgacatgaatcagaacgaggcgctggagcgtttgtacgagagcatcctggcggatcgcccgttgccgtgggcctatgtcggcctggggcgtctgctgttcaagcgtggccaggtgacccaggccaaggccgtctatgaaaaggccttgaaggccttcccgatgatgccggcgctctacgatggcatggccgatgtgctgctcgccgagggtgattccaggcgcgcccagagtgtgctggaggaggcggtgcgcctgtcgccgctggccgtgcgccggcaagcgctgctgggcaagctggcgatgaccaacgaagacttcgagaccgcatccaaggcgtatcgccaggcggtgtcgcaaggcgcgcaatcgcgtttcaaggatccggaaagcaaccttggcctggcccatgcgttgatcagcaagggcagcgagaggggcctggatacccgcacacgcctggaaatcaacagcaccctgagtgcggtggccaaggaaaaccccagcgatccggggctgcagattcgtgcgcgcctgatgaaggccaccagcttgttgctcaacgatgctgaaacagcggaaaaactcaccgagcaggcgatgctgcgtctggacgggatggagcaattcatgagcccggaagcggcgttgctggtagccaagcaactgcagatgctgggacaggccgatgccggcgcatcgatgctgaagaactgcgcggaaatctacggtgacgatccgaaggtgatggaaggcatcgccaagctcaccgatgacccggcgatcctcaactccgctaacgccgcggcggacatgaaccgtcaaggcgtgcgcagctacaaggccggcgcgttgggcgaggcccgggatctgttccgtcgggccctggccatgcaaccgaagaacatcagtattgccctgaacatggcgcagtcgctattacacggcaccgacatcacccaggacacggcactgctggatgagtgccggacctgcctgaaaatggtcggcctgatgcccgataccgacgcgcgttatccgcgttatcagaagctgcgaagcaaggcgtttggcgaatgaatacccacgaacaggctctcgacttttccacggtgatcgcctctaccgtgcacgacatgaagaactccctgaccctgctcatgcaggcccatgcccagtggctggcggcactgccgcaggcgcaccagggcacgccggagcagggcgtgatggagttcgagtttgcccatctcaacggcatgctggtgcaactgctggggctctacaaattgggagtcaaccagttgccggtgcagccgggttaccacgaactggatgacttcatcgaggcgcaactggtcagccatcaggatgtatttgtcagtcgtggcattgccgcaacctatgaggtcgatcccttgacccccctggggttcttcgatcgggaattgatcgcctcggtgctggacaactgcatcaacaacgccattcgttatgcgcgccatgcgttgctggtcagcgtgcacgatgaaggcgggcagacggtgctgaccatcaatgacgatggcgagggttatccgcagtcgatgatcgataaccaggccgactacgtgcaaggcatcaatcacagcagcggcagcaccggcctggggttgtacttcgccgggcgcattgccgcgctgcatcagcgcaacggtgtctgcggacgtaccgagattcgcaacggcgggcctttgggcggcggtgtgttcagtctctacctgccctgagccagctgctgttgcgcttgctccagggcctgtagaaagcaggtcagggcggctttcggctcctggccctggcgggtgatgcagtgaaaggtcgaacgataggccaggcgctgcggtaacagggcgcgcatttggcccctggccacccagttggcggcatagtggctgggcaggtaacccagatagctgtcggaaaataccagggtggcaatcgcttccatggtgtagacggtggcgctctgcaaaaaatacaggccatgggggcgctggttctcagccatgtagccacgaccgacatagggtgtgttgcatatttcttccagggtcaggtcggtgtcgctgcgttgaaacagcgggtgcccagcagcgcaatagagattttgttcctcctcgaacagcggctggtagcgcagcccggagagctggtggtggaaggctccgatggccaggtgcaggcgctcgtcgagcacggcctgttcaagctcgtcgggacgcagtatgtgcaggcccaggcggacttccggcaggcgctggcggaacaggttgatggccaggggcaatggcgcataggacaggctgagcatgctgtcgacattgctgatctgtagatggtcgcgtgccggcccgccgagttggttggcctgctgccgaaagcgctcgatgtcgcgaaacagcaactgcgcagcatcgaacagttccagcccttcctcggtcaattggaagccactgctaccgcgtcggcacagcgagcagcccaggcgctcctcgagatcgcgtaccaccacgctcaggcgcgacaggctggtattgagcctggcctgggccgcggtgaaaccaccggcgtcgactatggtgcaaaagacccgcagcatgcgcaggtcgatatcggataggctgcccagcacattggcctccatcaggcgcggcaaggggatgggcaaagcctacaccggtgcgggtcgaagggcggcgacacttccaccacatcggctccgatcaggttcaggccgcgcaggccacggatcaactgctgggcctccagggtggtcatgccgccgatttccggggtcccggtgccgggggcgaaggccgggtccagcacgtcgacatcgaagctgacataggtcgggccgtcaccgaccacgcgtcggacctcggccagggtggcggcgacgccgatctcggcaaactcttccatatggatcacgcggatgccggtctcggcagcgaaggcctcgtcatcggccgaatagaccgagccacggataccgatctgcacggtgcgtcgcgggtccagcaggccttcctccacggcacgacggaacggtgtgccgtgggtgtagggattgttgccgaaatagcggtcgttggtatcggagtgagcgtcgaaatgcaccatgccgattggccgctggcgggccagggcgcgaaagatcggcaaggtcaccagatggtcgccgccaacggccaggggcacggcaccggcttcgtgcaagtcgcggaaaaaggcttctatgcgcgacagcgagtccagcaggtcgatggggttgacgggagcgtcgccgagatcgccgatgcgcaccaggtcatagggagcgatacggctgacatggtgcaccttgcgcatcaggctggagaggttgcgcacttctcgcgggccatgcctggcgccggcgcggttggtggtgccgccgtcccagggcaccccgaccagggcgatctgcacctgggccgggtcatcaaagaccggcaggcgcatgaagctcggaatcccggcgaagcgtggcaccagcgctgcgtccacgggttggggaaaatcattgggcatggtggagctcctgtggcgaatgggagcggcatgtggctgctccctgggtaagcgctgtcaatggggttcggtggacggcgcggcgaccgggttggtcagcaggggccttgcgcatgctccaccagccgagcgcgaaaaaatcatagggcggggcgtggcaggccgataaatcatcagctcggcaagctggcttgtgttttgtgacaagttccttgagagcgttccttgcgaaggcatgccggatgatggttgtctatccgggtatttcgagtgtccctgcttgatattccgaacagccggagcctattttgtacgggtcgccgttctcggctcgtacaacaacaaggattgagtcatgacaaccgatggccgcagttcactcgctcagcgattgacgggcattgacgagattgaatgtgtcactccggatctgaacggcgtgccacggggcaaggtgatgaccgccgagggtttcctcgaagggcggcgtctgcagatggcccgtggggtgctgttgcaatgcatcatgggcggctatccacccgcgcgtttttacggcagtgacgacggcgacctggcgctcactgccgacccgcaacagattcatcgcctgccctggagttcgcagccacgtgcgctggcgatttgcgatgcggacgagttgagtggtgaaagctcgcgtctttccacccggggccagctcaaagaggtcatcgcgcggtacgccgctcgcggcctggcgccagtggtggcgaccgagctggaattcttcgtgtttgctcccaataccgatccgacccaacctttccagccgccccttggcctggacggtcgtcgcgaggatgggcattcggcgttcagcgtcagttccaacaacggtttgcggccgttcttcagtgaggtctatgcctgcatggcggcattgggcttgccgcgcgataccttcatgcatgaaatgggcgtcagtcagttcgagatcaatctgctgcacggtgatccgctgttgctggccgaccagacattcctgttcaagcacctgctcaaggaagtggcgctcaagcatggcctgaccgtggtgtgcatggccaagccgctggcgcacacgccgggcagttcgatgcatattcaccagagcctggtggagtcggccagcggccgtaacgtgttcagtgatgaggccggagagccgaccgcgatgttccgccacttcattggcgggctgcaggcggggatggcggatttcactgcgctgttcgcaccgaacgtcaattcctaccagcgcctgtgccatccttacgcttcgccgaacaatgcctgctggtcccatgacaatcgggcggcaggcctgcgcattccggccagttcgccggtggcgcggcgggtcgagaatcgtttgccgggcgccgatgccaacccgtatctggcgatcgccgcgagcctggcggcaggtttgcacggtatcgaaaacgagctggaaccgacgccggcgattcagggtgagtttgccgtgccggacagtttatctctgccttgtaccttgcatgccgctcttgagcgtctgaaacgtagccagttggccaaggaattgttcggcaatgagttcgtcgaaggttacgtcgcttcgaagaccatggagttgaccagtttctttgatgaaataactccctgggagcggcgcgtcttagcggcccaggcttaaccgaaccatcgcagtcgggctatcgtccagatggcccgacactcaattcaaggagccgctcggaacgccgatgcgccaaatctggaaatcctttcgagcgctttatttcgcctcgctgatgatgttgatcggctcgggcttactcagtacctacctggcgttgcgcctggccgccgatcatgtcgacgggttatgggtgggggccttgatggcggccaactatttcggcctggtgctgggtgggaaaatcggccaccgcctgattgcccgggtcggccatatccgtgcctacgccacctgtgccgggatcgtcggcgcagcggtgctggggcatggcctggtggactggttgccggcctggctggtgctgcggatgatcgtcggcctgggcatgatgtgccagtacatggtcatcgaaagctggctcaacgagcaggccgatgccaagcagcgcgggctggtgttcagcggctatatgatcgcctcgtatctggggctggtcctggggcagttgattctggtcatgcacccggccctcgggcttgagttgctgatgctggtggccctgtgttttgccctgtgcctggtgccggtggccatgacccggcgtattcaccctgcgcctttgcatcctgcgcccatggaaccgcgcttctttatcaagcgcgttccgcagtcgctgagtacggtgctcgggtcggggctgattgtcggttcgttctatggtctggcaccgctgtatgcctcccagcagggcttgagtaccgagcaggtcggcctgttcatggggagctgcatttttgccgggctggtggtgcagtggccattgggatggctgtccgaccgttatgaccgggccctgctgattcgctgctttgcctgcttcctggcggtcgtggccttgccgttggcgattttgccccaggtgcccctggaggtgctgttcgccctggggttcctctgttcgctggtgcagttctgtctgtacccgctggcggtggcgttctccaacgaccatgtcgaaggcgatcggcgggtctcgctgaccgcgatgctgctggtgacctatggcgtcggggccagtgtcgggcctttggtggcgggggtgctgatgaaattgttcggtagccagatgctctatgcgttcttcagtttctttgccctggtactggtctggcgcatccggccgaaagccgtgaccaacctgcatcaggtcgatgatgcgccgctgcatcacgtggcgatgccggacagcatgtccagttcgccattggtggccgcgctcgatccgcgggtcgatgagcaagtggtgcaggatcagatgcaacagaccagcgcaccggaagccgagcctccggtcgagacgccggccacggatgaggtggaggctgaggagccggtagtgaagccggatgaaccagggccggaccagttcagtggggccaggccctagaaacgcaaaacgggcagccccgcaagggactgcccgttttttatcgacgctcgaatctcagaggtcgtctttgtcgaagcgccgggcttcgcgttgcagctgatagacgaagcgctcgacctggcgttgaaccaggccgctcatgttgtgaaagcgcacaccggcgaaagtcgtgtcgatcttctcttcgtggtgcaggtaacgcagttccactggtgcagtcatgctgccgaagggcagggcggcgataaaacgctcgtagacctggcccagttgcaggcggccggagatgtcgccctcgaagcgcagcttgcagccggtggcggagatatccagcagcttgccggcgatcggcgccttgagtttttcgccgcccagttcgatgttgaccagttgggccagcttcagggctgcgcgaaaggcattgcggcgctggtgatagaccacttcgtctggcagggtgccgcggtagcatcgcccaccattggattcgtcgatagtcgggatgccattgctttcccaggcgatgcgcacgccttcgtgaaagccttcgacgcgaaacggttcgccggcgagcatgaagcgttcgccatcgcgggggatcatttcgtccagggcaatcatgttgctgtcacgatcgatctcgaccagatagctttgaaagcgctggctgcgttcgtggaaagtgatgatcagcgggtcatggctgtcttgcagcaagcgcagcgtggagttgatttccaagggggtggtcagcaccttgggtggctgcggcgcatcttctgcgtttacggcattgaacacggttcatcaatctccagacaaaatacgactacacgcaagagccggcattttgccagcatgttccgcgacttgatagggcgcgctcatctctggggtcaagcctggctaagcgggcgaggcttggccagcttggcggttgagccgcgggcatcatagagggctggaggctcgccaccggtgaggattttcaattgattggcggtggtggcctgttgaacctggatcgagcgaccgttgagttcgttcgccgcctggcaatcggcaagcatttgggtcagcacgtcactctgggccagtaactggtcgccgatcgaggagtggctggccaactgttccaggccggcgcggctggcaggaaggttcaggctggcgaggagttcgctgcgtttgcggccatgctgctcgagcaaaatgatcagggcttgcttctgcgcgagaatctcttccagcagcggcatgtcgcgaccgtgcagggctagggattcggtgcgcaacaattccagcaattgttgagctggagcaaagtcgtcggtgatcagttgcagcaaattagtgtcgtgcatgtatggccttgggttttaagcgtccaaaaaactggcgcaggccttattggctagcgctgggcttcgaaattaagcagtttgctggctacacggttgctgtcgactttatagctgccatcggcaatcgcttgcttcaactcggccacgcgggcgttgtcgacggcaggctggtcgcgcagcttgtcagtgatcttctgcaactgttgagcctcattactgaggtgtaccgactccccgctggtgctggcctgttcggccggagcgttcagcggcgcggatttgtcggcgtcgccggtttccttgctggcgctggtgcgcgtgctgccggtgagtgagggagagctgtttaaacggctgaaatcgatgaccatggtaaaaaaacctctgggtatttggacgcttgacttgttttcggcaatacgccggaaaactttaggctcaaatatcgataagcccgcacgcgccgctgttgccctgcatgggccacagtttagggggcaacagtgcacagcgccagtcgtctacatggcgacttccacctgtcccggcgcggtgatccgcgctttgatgacccgttgtgaattgaggttcttgacccggatctgctcgctcataccgccattggacaaggcttcgccgggcattttcacgttcagcgtgccgctacgggcagagatcaccacctgatcgcccttgcgtaccacttccgcctgttccaggtgaaccagggtgacgagttggtcggcgaccatcggtcggacaagcttctgcccaatggcctggtccactgaagtcagatagccctggttgatctggccgatatcgcgctcgcgcagcatcacgtcttcggggctgatgatgccggcgcgcttgaggggccgggtggtggtgaccacttcgcggaacagcttgacctgggcgggcacgaatacggtccagggcgaggcgccgtcgcaacggacgcgaacggtcacgcgtcccagcggctgtgccgggctttccagggtcgctgtcaattccttgtcgcaatgcggcatgcgcagccgcgggtcgagctgattgacctggatctcgtagcgcccaggcgtttgactggtttccagatagtcttctacggtgaattcaagaaacccctgagtgacgccgataagtagatcaggcagggttaccgagtcagcaacggcaggatggccagggtttaaaaaaaacaaagccgacagcccgtacagcaatctgcggtagtttgatgtcaggcgtcgggaaaatgtcgttttggcgttcataacagttaaaaagcaagcgccgtgccgtttagcgatgagcgcgtcggatcttaagctttggggagtctgggcatggctggtgtaatggattcggtgaaccagcgcacgcaactggtagggcagaatcgccttgagctgttgttgttccgtctcgacgggcagcagctctacgggatcaacgtgttcaaggttcgggaggtgctgcaatgccccaaactgacgttgatgcccaaatccagtcctgtggtgtgcggtgtcgcgaatattcgaggggcgaccattccgatcctggacctggcgatggccaccggttcaggcgggttgcaggatctgagcaacccctttgtcatcatcactgagtacaacaccaagacccaggggtttctggtgcggtcggtcgagcgcatcgtcaacatgaactgggaggagatccatccgccacccaaggggacggggcgcgatcactacctgacggcggtgacgcgggtggacaatcagttggtggaaatcatcgacgtcgagaaggtgctggccgaggtcgcgccgacgcccgagaccatttcggtaggcgtggtggatgtcgagactcagcacaaggctgtttcactgcgggtgctgacggtcgatgactcgtcggtggcgcgcaagcaggtcacgcgttgcctgcagaccgtgggggtcgaagtggtggccttgaacgacggccgacaggcgctggattacctgcgcaagctggtcgacgagggcaagaagcctgaagaagagtttctgatgatgatctccgacatcgagatgccggagatggacggctacaccctcacggccgaaatacgcaacgatccacgcatgcaaaagctgcacatcatcctgcatacttcgttgtcaggtgtattcaatcaggcgatggtgaagaaggtcggtgccgatgacttccttgctaagtttcgtcctgatgacctggcatcccgggttgtcgaccggatcaaagcagcagataacagctagggatatccatccctggcggtcacacgatttaagaggcggcatcattgtctacgggtaatttggatttcgaacagttccgggtgttcctggaaaaagcctgtgggatcttgctgggtgagaacaagcaatatctggtgtcgagccgtctcaacaaactgatggaacagcaaggcatcaagtccctcggggagctggttcagcgcattcagtcccagccgcgcagcggtttgcgagagatggtggtcgatgccatgaccaccaacgaaaccctgtggtttcgcgatacctatccattcgaggtgttgaagaacaaggtcttgccggaggcgatcaaggccagccccaaccagcgcttgcgcatctggtcggcggcctgttcctcggggcaggaaccctattcgttgtccatgtcgatcgacgagttcgagaagaccaacatggggcaactgaagatgggggtgcagatcgttgccaccgacctgtccgggaccatgctgaacaattgcaagaccggcgagtacgacagcctggcgatcggtcgcggtttgtcggccgaccgcctgcagcgctatttcgaccccaaggggccggggcgctgggtggtcaaggcgccgatcaagagccgggtcgagtttcgctcgttcaacctgctggacagctatgccagcctgggcaaattcgacgtcgtgttctgccgcaatgtgctgatctacttctccgccgaggtgaagaaggacatcctgatgcgcattcacagcaccctgaagtcgggtggttacctgtttctcggggcttccgaggcgctcaatggattgcccgaccactaccagatggtccagtgcagccctgggatcatctaccaggcgaagtaagattgtcgttgttgaaaagagaggccttcgggcctcttttttgtgcctgcgattttgccagcgcaggagaggcggcaaccgctgcattgccgctttgctgacgtttcgcggaaatgccttgccgcttttctggcattgccgctttgccgctgccggcaaagccttgatttacgggctttgagcacttggcacgcggcttgctatatcccgtttacgaaaaatctggtcgaaggtttcccgacatgagcatcagcttcgataaagcgctcggcattcatgagcaggctcttggctttcgcgccaagcgtgccgaggtgctggccaacaacatcgccaacgccgacaccccgaactacaaggctcgggatctggacttctctgccgtgctcgccgagcagaacgagaaagccaagaacggcacctttgccctgaacatgaccaacagccggcacatcgaagccgaaggcctgggcagcggcgacgaatcgctgctgtaccgcacaccgatgcagccgtcgatcgaccagaacaccgtggatgcccaactggaacagtcgaactacgccgagaactcggtgaacttccaggccagcttcacgctgctcaacagcaaattcaaagggctggtgtcagccctgcgcggagagtaatccatgtccctcgccagtgttttcaatattgccggtagtggcatgagtgcccagaccactcgcttgaacaccgtcgccagtaacatcgccaacgccgagacagtctcctcgagcatcgaccagacctaccgtgcgcgccacccggtgttcgccaccatgttccagggcgcgcaaagcggcggcagcgagtcgctgttccagaatcaggacgcggccggtcagggcgttcaggtgctgggtgtggtcgaggaccagagcaacctcgaggcgcgttacgagcctaaccatccggcagccgacgccaaggggtatgtctactaccccaacgtcaacgtggtggaagaaatggccgacatgatttccgccagccgctcgttccagaccaacgcggaaatgatgaacaccgccaaaaccatgatgcagaaggtcctgaccctcggtcagtgataaggggcgactcagatgagtgttaccgataccaccagtagcctgacgctcaaggagatccttgcgaactcctcgaagaaaaccccgaccaccagcaatgacggcctggccgcggccaccaatagcgtcaaggggaaaaatgagctgggcaaggacgcgttcctgaagctgctagtgacccagctgaaaaaccagaacccgctggacccacaggacaacagcgagttcgttgcccagttggcgcagttctccaccctggaagggatcaccaccctcaatacctcggtgaactccatcactggcaactataagtcgtcccaggccctgcaggcttcgtccctggtggggcgttcggtgatcgtccagaccggtaccacccaggtcgacaccaccaagagcatgaccggttcggtgacagtgcctaccggagtcagcggcgtcaccgtgaccatcaccgacaaggatggcaaggaggtcaagactctcgacctgggcagccagaaggccggcagtaccagctttgtctgggacggcaccaagaccgacggcaccaaggccgatccgggcaattacaccttcaaggccagcacaaagatcgatggcaaggcgaccgacctggtcacctacctgccggcgacggtcaacagcgtcaccatcagccagaccggcggtgagctgatgttgaacctcgcgggactgagcagccccgtggcgctctccaaagttcaaaccattggtatctagagccgactaacgcggcacaaggagtggaatatgtcttttaatatcggccttagcggtctctatgctgccaacaagcaactggacgtgaccggcaacaacatcgccaacgtggcaaccaccggcttcaaatcgtcccgtgccgagttcgctgacgtctactcggccaccaagctgggcaccggcagcaagaccgtgggcaacggtgtgcgtctggccaacgtttcccagcagtttggccagggcgatgtgaacaacaccggcaacgtactggacatggggatccagggttcggggttcttcgtgctgagcgacaacggctcgctgacctacacccgcgccggtaccttcaagaccgacaaggacggctacatcaccaacaccgatggcactgcccgcctgcaaggttatgcggtcgatgccaatggcaagatcgtcaacggcgtgctgaccgacctgcgcatcgacacctcgaacctgtcaccgaaggccaccagctcggtgtcctcgaccatcaacctgaactccaccgcgccggtcatcgaccagagcgtgacaggttttgccttcgatccgaccaaggtggaaacctacaccaagcagttcagcacaccgatctatgacagccagggcaacgagcacaagctggaccagtacatggtgaaaaccggtgccaacacctggaagacctacaccctggtcgatggtcgtaacctcgatggctccgctccgaccaccaccggcgctacggctccagtcgcatcgaccatgaatttcgactccgccggcaaactggtttcggtcatcacgccgcctgccaccacgcctaatccgggtaacaacctgaccctggcgggctgggtgccaggtaccgtgaccaatggtgtgtgggcggccaacggtgccagcgccaatgccggcggcgtgaccatctccatgaccagcaccactcaattcaacgccgataccgcgcgttcgctgccggtgcaggacggctacgccactggccagatcaccaacctgaccatcgacggcaccggtaccctgttcgccaacttcagcaacagccagaacaaggccatcgggcagatctccctggccagcttcaccaacgaacaaggtttgcagccagtcggcggcaccagctggagagagacctacgcctcgggcgtaccgggctacgatgctccacaaaccggcaccctgggttcgatcgtgtccaactccctggaagagtcgaacgtcaacctgaccaacgagctggtggacctgatcaaggcccagagcaactaccaggcgaacgccaagaccatctccacccagagcaccatcatgcagaccattattcagatgacctgataatggctggctgacagcgccaaaaaagcccctcaccgcaggggcttttttgtgcccgcaagattcatccaccgcaatctgcttctgtaggagcgaagcttgctcgcgataagtcatgacactcaggtaggggcagccggtagcggctgcggaggatggagagggcggcttttccccaggccaaagaaaacccccggcaggcagggcctgtcgggggttcggataagcgccgggaggcgcctatcggttcagcttattggcaagcttcgcaatccggctcgtcgatggcgcaagccttcggcactggagctggaccggctggagccgccaggaccgagtcgtcaccgtggttgccgccgctggaaacagcgttcagcttgccggtattgatggtcgacttctcggtgctggtcgcggccagagcacggaggtagtaagtggttttcaggccacggtaccaggccatgcggtaggtcacgtcgagcttcttgcccgaagcgccggcgatgtacaggttcagcgactgagcctggtcgatccacttctggcggcggctggcggcgtcgacaatccacttggtttccacttcgaaggcagtcgcgtagagctccttgagttcttgcgggatgcgctcgatctgctgcacggaaccgtcgtagtacttcaagtcgttgatcatgaccgagtcccacaggccacgagccttgaggtcgcgaaccaggtacgggttgatcacggtgaattcgcccgacaggttcgatttcacatacaggttctggtaggtcggttcgatcgactgcgacacgccggtgatgttggcgatggtcgcggtcggcgcgatggccatgatgttggagttacgaatacctttctgtacacgggcgcgcaccggtgcccagtccagggtttcgttcaggtcgacatcgatgtacttctggccacgggactcgatcaggatctgttgcgaatccagcggcaggatgcctttggaccacagcgaaccctggaacgtctcgtaggcgccacgctcgtcggccaggtcgcaggaagcctggatcgcgtagaagctcaccgcttccatggacttgtcggcgaagtcgacagcggcatcggaaccgtaagggatgtgctgcaggtacagcgcgtcctggaagcccatgatccccaggccgaccggacggtgcttgaagttggagttcttcgcctgcggtaccgagtagtagttgatgtcgatcacgttatcgagcatgcgcactgcggtgttcacggtgcgttgcagcttggcggtgtccagcttgccgtcgacgatgtggttcggcaggttgatcgagcccaggttgcaaacggcgatctcgtccttgttggtgttcaaggtgatctcggtgcacaggttcgaactgtggaccacgcccacgtgctgctgcgggctgcgcaggttgcacgggtccttgaaggtcagccaagggtggccggtttcgaacagcatggacagcatcttgcgccacaggtctttggcctggatagtcttgaacagcttgatcttgccgtactcgcacagggcttcgtagtactcgtagcgctcttcgaaggccttgccggtcaggtcgtgcaggtccggcacttccgatggcgagaacagggtccacttgccgtcgtcgaagacgcgcttcatgaacaggtcagggatccagttggcggtgttcatgtcgtgggtacgacgacgatcgtcaccggtgttcttgcgcagctcgatgaactcttcgatgtccatgtgccaggtttccaggtaggcacacacagcgcctttgcgcttgccaccctggttcacggctaccgcggtgtcgttcaccactttcaggaacggtacgacgccctgggacttgccgttggtgcccttgatgtaggagcccagcgcacgcaccggagtccagtcgttgcccaggccgccggcgaatttcgacagcatggcgttgtcgtggatggcgccatagatgcccgacaggtcgtccggcactgtggttaggtagcagctcgacagctgtggacgcagggtaccggcgttgaacagggtcggagtcgaagccatgtagtcgaaggacgacaacaggttgtagaactcgatggcacggtcttcgcgttgtttttcttcgatcgccaggcccatggccacgcgcatgaagaagatctgcggcagttcgaaacgcacgccgtccttgtggatgaagtaacggtcgtacagggtctgcaggcccaggtaggtgaactgctggtcgcgctcgtggttgatcgccttgccgagtttttccaggtcgaagtcggccagcacagggttcagcagttcgaactcgatacctttggcgacgtaggccggcagtgccttggcgtacaggtcggccatctcgtggtgagtggcgctctcggccacttccaggaagctcaggccttcggcgcgcagggtgtccatcagcaggcgggcagtcacgaacgagtagttcggctcgcgctctaccagggtgcgcgcggtcatcaccagggcggtgttgacgtccttgagcgctacgccgtcgtagaggttcttcagggtttcgcgctggatcaggtcgccgtcgacttcttccaggccttcgcaggcctcggtgacgatggtgttcaggcggcccatgtccagaggcgcgaagctgccgtcggcgcgggtgatgcggatcgatgggtgagcctgcaccggctcttcgcctggggtgcgggtggcgcgctccttggcgcgcgagtcacggtagatcacgtagtcgcgggcaactttctgttcgccggcacgcatcagggccagttcgacctggtcctggatctcttcgatatggatggtgccgcccgaaggcatgcgacgcttgaaggtggcggtgacctgctcggtcaggcgagcgacggtgtcgtggattcgcgacgaagcggcagcggtgccgccttcaactgcgagaaacgctttggtgatggcgacggtgattttgtcatcggtgtaaggaacgacagtgccgttacgcttgatcactcgcagttggccaggcgcggtggcagacagatccaggttggaatcggcagcctgcggcgctttggcctgcgggttctcgcgagttgtgtcggtttgcatgggtgtctccacgttctctatgtttgtttgggcaccctttgggtgcccaccgttccgtcctgaagcactacaaccggcgcacgccgggcataacgacttcgggacagttgaggaaggggggctgttggcgccgcttccatgccgaagtcataggtcgcgagccagtggctcgtgaccgtattcctggtgggtgacagtcatgtactgcaacacccgtaccgttttcctcgccgtgggctggaaaaccgcagccatccgcacgcgcggtttggcttctgaaaatccgattggttccaccaaacgagtgcaagaaaagcgcttgagtttcttgtctgatttgtgtttggtttttggcctgaaaccctagatgtagggtttttttgcagccgagctacaagataatgcgttttggggtgattgcaacgtacagcctgtggataaggttgtgcgtaaattgtgtatgaagcaggtaaacctcacgcaggccgcagcagggctggatcctaccgtttgtcactgttttttgccctgcaaaactgcccgcggcggatttttgcgggcgcgaaccctatcacaaaaaaacgcctttaccgagcgcattcagcgccttgtgttcacggccttcgccgttgctacaatcgggccttccagacattgttttatccatctcacattacaaaaagacgggcggattcttccggagcccgtatctggcaagcagaggtcaccgtggagcaagaagcgtggcagatattgatcgtcgaggacgatcagcgactggccgagttgacctgtgaatatctgcagagcaatggattgcgtgtcgccatcgaaggcaatggcgccctggccgcggcgcggatcattgccgaacaacccgacctggtgatcctcgacctgatgctgcccggcgaggatggcctgagcatttgccgcaaggtccgcgatcgctacgatgggccgatcctgatgctgaccgcgcgcaccgacgacatggaccagatactggggctggacaccggtgccgacgattacgtgtgcaagccggtccgtccgcgcctgttgctggccaggatccaggccctgctgcggcgcagcgaaccggtggaaagcagcgcgccggagaaatcccggcgcctgcaattcggtccgctggtggtggacagcgccttgcgcgaggcctggctgcacgatgccgggatcgagttgaccagcgccgagttcgacctgctctggctactggtggccaacgccgggcgcattctgtcccgcgaggaaatcttcaccgccctgcgcggcatcggctatgacggccaggaccgctccatcgatgtgcgcatttcgcggatccgcccgaaaatcggcgacgacccggaacacccgcggctgatcaagaccatccgtagcaagggttatctgttcgtccccgaagccgctgccgacctgtcgccgtgaactccatattcctgcgcatctacggcggcatgtgcgccgccctgattctggtggcgctgttgggcgtactggcgctgcacctgctcaaccaggtgcgtagcgagcaataccgcgagcgcctggcccacggcacgttctcgctgatggccgacaacctgcaacccatgagcgaaatcgagcgccgccgcgccctggcagtgtgggagcgcctgttgggcatcccgctgaccctgcagaccttcacccagaccggtctcgacctcgggcagcgcaaccgcgttttgcgcggccaggccctggtggagcagaccgggccttacgcggcgcgggtctaccgtctggtcagcgaacctgagcaattgttgctgaccggtgaggtgcagcaaatcagcgaacaactggcgcgggcgactatctatctgctggccgacgagttggtgcgctttccggtggccgagcagccggaacgcctggcggcactgaaaaagaacaaaggctttggcttcgacatgcacctggtcacccaggacgacgcggacatggacgaggaccagcgtcgccgggttgccgagggcgatacggtgatggcgctgggcaagggcggcgattcgatccgtgtgttcgcagggatggtgggcacgccctgggtgctggaaatcggcccgctgtaccagatgaatccctacccgccgcaatggctggtgttgatcgcggtgctgggcctgagcctgatcggcctgatcgtctatttattggtacgccagctggagcggcgcttgcgtggcctggaatcggcggccacgcgcattgccaagggcagcctggaagcccgggtgccggccggtggcgcgattccgtgggccggttggcggcggccttcaatggcatggccgagcatttgcagcgcttgctggcgatccagcgcgagctggtgcgcgcggtgtcccatgagttgcgcacgccagtggcgcgcctgcgctttggcctggagatgatcggctcggcgaccaccccacaggcccgggacaagtacatggagggcatggacaacgatatccaggacctcgaccggctggtggacgaaatgctcacctatgcgcggctggaacagggttcgccggcgctgaacttccagcgcatcgacctggacgccctgatcaaccaggtgatcagcgagctggcgccgttgcgcgcgcaggtcaaggtacagcgtggttcgtgcctgtccgcggcggattgcgatggcgcctgggtcgaggctgagccgcgctacctgcatcgggcgttgcagaacctggtgagcaacgccatgcgccacgccgagtcgcaggtgctggtcagttaccaggtggggcagatgcgttgccgggtcgatgtcgaggacgatggtccgggggttccggaaagcgcctgggagcggatcttcaccccgttcctgcgcctggatgacagccgtacccgcgcttcgggtgggcacggcctggggttgtcgatcgtgcggcggatcattcactggcacgacggccgggcgttgatcagcaggagcaagaccctcggcggcgcctgcttcagcctgagctggccacggcatcaggataaaggttgaaggcttgcgctcaggttcgtccgggcatcaagcccggatgctgaccaggctcagcagttgcccgtcctgcagggcgaattgcgcatccagttcactgccattgcgccattcgctggacaggtccgtcagcaggcgcaggcggacctggccgctggccgtccactccagcacttcggcgtgttcgaaatagaagcgttgctggacgatcgggtacagcgccttgaacaggctttccttcaccgaaaaggtcagggtgacccagagcgccagttgttcccgcggggcggccgccatgcgctgcatttcggccgggatgaggatttcccccgccaggcgctccgcccgttcgctgttgagcaggttctccaggtccatgcccagcccccgccaatgctccttgcgcgcgacaatcgccgcggcacgcccggtgctgtgggtgatcgagccgctgatgtgcgtcggccagaccggcgcccggtcctcgccgatcggcggaatgcagtccaggccgtccaggcgttgcagggcggcgcgggcgcagaaacgcccggcgagaaactcggcctgccgtttcgccaccgaacgttgaatgctcgcgggcggctcgatggcgctgagctggaagtcgttgctggccaggcgcgaggcatcgaaatgggtgccgagcaggacgacgtccggcagggcgtcgggcagcggccactggtcgtcgagtggggtgcagcaggcggggagggtggggatgagattcatgccaggcattttgccgggttgtaaggctggagggtagcctggcaggcaccggcctcgatgccgccgccccaagaattgaggtctcgaggcggtcgacgcagggtcagccgaacagcttcttgaagaacgcctgcatatccgcccatgagcgttcatcggcggccttgctgtagccgatatccagcccgccatgttcgccatggctcatgcggtcggcatccggattgctgaagctgtgcttggcgccttcgaggttgacgaactggtagtcggcgccggccttgtccatttctgccttgaaggcgctgacgttatcggcggtgaccatgctgtcgagggcgccgtgctccaccaggattttcgccttgacgctgccaggagtggccggggtgctggtgaccagggcgccatggaaactcaccacgccgagcaggggaaggccctggcgcgccgcgtccagtaccaccttgccgccgaagcagtagccgatcgcggccagcttggccgggtcggtctgtggttgtttcttcagcaggtcgagcccggccttgaagcgcgcgctggcggcggcactgtctttcgaggcggcctgcatgaaggccatggcgtctttcgggtgttcggtgttcttgccgtcgccgtacatatcgatggacagggcgctgtagcccagggccgcaagatcccgggcccggcgtttggcatagtcgttcaggccccaccattcatgcaccaccacgacgccgggacgtggcccttgcaagctgtcgtcataggcgtagtagccgatgagccgggtaccgtcggggctctggtaggggatttcctgggtcttgatggctgcctggctcaagccgcagaaagccaacaacaagcaagcgaaaagcgtgcgcatggtccgttctccttttaaaagactgccagacagcctagtcgatttgattcagccgaggttcagagtgtgttcagggggagttcagggcggggtcggtagtctggctcccgtacccaaaaacacatagcgaatgaggaaacaccccatgactactttcaagaagatgatcctggccttcactgttctcggcgccagcgctgtcgtccaggccgccgacagcaacttcgccagccttacctatggccagaccagcgacaaggtcaagaagtccagcctgctcaacagcaacctgaacaacccgaacgccgacggtgtgatcggcaaggacaacacctggggcgtgcacctgggtcagcagaatgaccagcaccgctactacgccacctacgacaatgtctccggctcgcacaatggcattaaactgcgccaggaaaacctgctcggcagctacgatgtgttcctgccggtgaccagcagcaccaagctgttcggtggcggtaccgcgggcctgaccaagctgacccaggattccccaggcttcagccgcgacagcgatatcggttatgccgtcggcgtgcaggccggtgtcctgcagcaggtttcacagaacacttcggtcgaactgggttaccgttacctgcgcagcaatgccagcaccgagatgagcgagcgcagtggcagcaagcagggttcgctgagcctgaccagcagcgcccagacgtacctgtcggccaactacgctttctaaaatattgtcctggttctgaccgcgccggatctgccaaggcaagatccggcgttgccatatatacgatcagggcgcctgagcgcccttggagatgtcgaattttgcctgggagagctgcatgaaactgctcgtcgttgaagatgaggcgctgctgcgccatcacttgcaaacccgcctcacggacagcggccatgtggtcgagtccgtggccaatgccgaggaggcgctgtatcagaccgagcagttcaaccatgatctggcggtgatcgacctgggcctgccgggcatgggtgggctggacctgatccgtcagctgcgctcgcggggcaaggcgtttccgatcctgatcctgacggcacgcggcaactggcaggacaaggttgaagggctggccgccggcgccgatgactatgtggtcaagcccttccagttcgaggagctggacgcacgcttgaatgcgctgctgcgccgctccagcgggttcacccagtcgaccatcatcgctggtccgctgctgctcgacctgaatcgcaagcaggcctcgctcgacgaacaaccgctggcgctgaccgcctacgagtaccggattctcgagtacctcatgcgccaccatcagcaggtggtggccaaggaccggctgatggagcagctgtacccggacgatgacgagcgcgatccgaacgtgatcgaggtgctggtcggccgcctgcggcgcaagctggaagggccgtcgggcttcaagcccatcgataccgtgcgtggcctgggttacctgttcaacgagcgctgccgatgatccgatcgttacgcctgcgcctgatgctggcggccacgacgctggcggtgctgttcatgctggcgttgttgccggccatgcaaggcgcgttcagcctggcgctgcaggactccatcgagcagcgcctggcctccgacgtgaccacgctgatctcggcggcccggatcgagaacaatcacctgcaaatgccggcgcaactaccggacgagcgcttcaacctgaccgacagccgtctcctgggctatatctacgaccgggaggggcgtctggtctggcgctccaaggcgacccaggaagagaacatcaactacaagccacggtatgacgggcgcggcaacgagttcgcgcgtatccgcgaggtcaacggccaggagtttttcgtttacgacgtcgaggtcaagctgctgggcggtaaaagcgcggcgttcagcatcgtcgccttgcagccggtgcgtgagtaccagttgaccctggagggggtgcgggaaaacctctacctcgggttcggcgccgcgttgctggtgctcctggcgctgctctggctcggtctgacctggggcctgcaggcattgcgccggttgagccaggagctggacgaaatcgagagcggcacccggcaaagcctcagcgaagaacatccacgcgaactgctgcgcctgaccggctcgttgaaccgcctgctgcacagcgagcgcgagcaacgcagccgttatcgcgactccctggatgacctggcccacagcctgaagaccccgctgacggtattgcaaggggtcagcgaggacatggccctgcgtcctcaagaccgcgaacaggcctgggtgctgcagacccagatcgaacgcatgagccagcagatcagctaccagctgcagcgcgccagcctgcgcaagagcggtctggtgcgccaccaggtgcgtttgcgtccggtgctgaaaagcctgtgcgacaccctcgacaaggtctatcgcgacaaacaggtgcgggtctcgttcgacctgccggagcgctgctatgtgccgatcgagcatggagccttgctcgaattgctgggcaacctgctggaaaacgcctaccgcctgtgcctgagcgaagtgcgcatcagtgtccgccaagacctccacggcgcgcagctgtgtgtcgaggacgacgggccgggcgtgccgccggaccagcgggcgcggattctccagcgcggcgaacggctggatcgccagcatccggggcaggggatcggcctggcggtggtcaaggacatcatcgacagctacggcgcgcaactgacccttggcgattccaccctgggcggggcggcgttccgtattcacttcccggtaatttgatcagggcgctcaggtttcctgggcgcggtaggcgcccggggtcagcccggtccacttcttgaacgcgcggtgaaaggccgatggctcggaaaagccggtctgctcggcgatctgttgcaacgacaggtcggcccggcgcagatggtagatggcgatatcgcgccgcaactgatccttcaactcctgaaagctcgtgccttcttcgcgcaagtgccggcgcagggtctgcgggctgatgtgcaggtgctgggcgatgctttccaggtccggccaatgattgctgtcgcggctgagcaggcggcgcagctggctgctcaggctgtcgccgtcgtccgggcgggccagcaggtcggcgggagagcgctcaaggaagtgcttgagggttcgttcgtcctgcagcagcggcatgctcaggtagcggctgtggaacagcaggctgctgcagtcgcgggaaaataccagggggcaggggaacagcaggtcgtattcgttgccgtgctcgggtttcgggtagctgaaacaggcctgttcgaggcggatgcgctggccgatcaaccaactgccgaggcgatgccagatcaccagcaggctctcgctgaggaagtgctccgggtcccacagcccagcgtcatccaggctcaggcgggtcatgtccccttcgcgcgtcaggctcagccgcggtgcctgggggaacaggctatagaacaacaggccgcgctgcagggccttctccaggttgctgcagtggatcagggcgtggcacatcatggcgaaggtgccgcgcttgctcgggccgtcgccaaaccccaggtactcgtcgtccaggacttgccagagctgttgcagcaggctggcgaactgctcgggggcgatacgggccttgggttcgttgagcagttcgaggctgatgcctagggtctgcagcaactccgaacagtcgtagccccgccgacgcgccccgcccagggcggcgcgggcgaaatgactggcgatggtgcgttcgcgcatgaaggttgatccgtccattaagtggcggatgttaacagccgacaacgactgggcaaggcggatatccgccaaattgtaggacgagcgtcgggcgatgggcggaaatccgccacttcatgtaggggcagggagagcgagggcgagcgcaaaccctgatgtccaaaggccttcagggtttttgggcaagctggcacgggctttgcgatagcgagcaaggagaagggagcagcgaaaggtgttccccgcagctctacacaacaaatccctccagtgcaggagggttcgcactttaggcgtcgtgtgcatcgatggatggtgtgcaacgatgctcttgaggaactttgcaatgacgactcgtcagccactgtacaaatccctgtatttccaggtgatcgttgccatcgccatcggcatcctgctcggtcacttctacccgcagaccggtgtggccctcaagcctctgggtgacgggttcatcaaactgatcaagatggtcatcgcgcccatcatcttctgtacggtcgtcagcggtatcgcgggcatgcagaacatgaaatcggtgggcaagaccggtggctacgcgctgctgtacttcgaaatcgtttcgaccatcgcgctgttgatcggcctggtcgtggtcaacgtggtgcaaccgggcaacggcatgcacatcgacgtgtccaccctggatgcctcgaaagtggcggcttacgtcaccgccggcaaggaccagagcatcgtcggcttcatcctcaacgtcattccgaacaccatcgtcggcgctttcgccaacggcgacatcctgcaagtgctgatgttctcggtgatcttcggtttcgccctgcaccgcctgggtgcctacggcaagccggtgctggacttcatcgaccgtttcgcccatgtgatgttcaacatcatcaacatgatcatgaagctcgcgccgatcggtgcgctgggtgccatggccttcaccatcggcgcctacggcgtgggttcgctggtgcagctgggccagctgatgatctgcttctacatcacctgcgtgctgttcgtgctggtggtgctgggcgctatctgccgcgcccacggtttcagcgtgttgaagctgatccgctacatccgtgaagagctgctgatcgtactgggtacttcctcctcggaatcggccctgccacgcatgctgatcaagatggaacgcctgggcgcgaagaagtcggtagtgggcctggtgatcccgaccggttattccttcaacctcgacggtacttcgatctacctgaccatggcggccgtgttcatcgcccaggcgaccgacacccacatggacatcactcaccagatcaccctgctgctggtgctgctgctgtcctccaaaggcgccgcgggcgtgaccggtagcggcttcatcgtgctggcggcgaccctgtcggccgtgggtcacctgccggtggccggcctggcgctgatcctgggtatcgaccgcttcatgtccgaagcccgcgcgctgaccaacctggtgggtaacgcagtagccaccgtagtggtcgccaagtgggtcaaggagctggacgaagaccagttgcaggccgagctggcttccggtggtcgtgctatcagcgacactcgcgaagaagatgacttgggcgttgccgaaggcccaaccccgacgtccgtgaagtaacttcaccgcgtcgatgaaaaacccgctgcggcgggttttttcatgcccggggtttgagcgcaacggtcagcccgggtggcgcttgcggtgattgccgggcctcgagacgctgcctactctgtgggcagtcaatcggcaagggagggtgctcatgcaagggccactggcgtcactcaaggtactggatttctccacgctgctgccggggccgttcgcctccttgctgctggcggacatgggcgccgaggtgctgcgcatcgaatcgccgacccgaatggacctgttgcgggtgctgccgccccacgatcagggcgtctccgccagccatgcctacctcaatcgcaataagcgcagcctggcgctggacctcaagcagcccgaggcgctggaggtgatccgccaactggtgctggagtacgacatcgtcctggagcagttccgccccggggtgatggagcgcctggggctgggctacgaggcgctgaaggcgctgaacccgaagctgatctatgtctcgatcaccggttacggccagaccggcccgtaccgggaccgcgccggccacgacatcaattacctggccctggcgggcctggccagctacaccgggcgcaaggacagcgggccgctgcccctgggcatccaggcggcggatatcgccggcggttcgctgcatggggtcatcggcctgctcgcggcggtgattgcccgccagcacagcggcctggggcagcacctggacgtgagcatgaccgattgcgtgttcagcctgaacgccatggccggagccggctacctggcgtgcgggatcgaacccgcggcggagcagcaggtgctcaatggcggcagcttctatgactattaccgcagtcgggatggtcgctggctgtcggtgggcagcctggagccgccgttcatgcaggcgctgtgcaaggccctggggcgtccggaactggcagcccaggggctgtcaccgcagccggaacaacagcaggcgctcaagcaggccttgcaggtcgagttcgagaagcacgattttgccgagctctgcgagttgtttgctggggtcgacgcctgcgtcgaaccggtgctgggcctggcggaggcggtgacgcatccgcagttgcaggcgcgacaactggtcagccaggtgccgcgtggcgatggcagctaccaggcgcagatggcctgtccgctgaagttttcccaggggctgccggagccgcggcatatcggggcggaactgggcgcccatagcgaccaggtgctggccgagctgggttacagcgcgcagcgcatcgctgagctacgccagggccgggtcatcctgtaggacgccagggccgggttcactccacccgcatctcgccgctgaataccagggtgtgccggcaacgccggcacagataacgccggccctgggcgaccaggcgatggcgctgggcggaaaacgggaagtcgttgtcgcaggggcagcggtagatgtagcgggtcacgctgcggcgctggatctcgtaggtgtggcagcgattgggcggcagttcgtacacgccgcgcatgatcagttgccattcttcgccgtggggctgaatgcgctcgccgaacagttggtgggcgatcaggtgcgcgacttcatgggccacggtctgtttgaggaagtcttcggtgttttcccggtacagctgcgggttgaagcgcagcaggttctcgtgcaggtgggcgacaccggctttctggccacgcaacttgaggctgaccaccgggcgtttgaaaggtcgtttgaaaaaggattcagcgagttggaaacagtcttcgacgcgggtattgagttgctcgggcatgcttaacggctctccagagcgggtgagtatgccgcaaagccgatgcattccgaatcgtccaggcgccgaatggtcgttgtgcagattagaaggccgccttgcggcggcctgtgttggcagattgtgttggttttttgagcgacgtcagttggtgtaaacggggccgacgccaagaccccagacgatcacggtgaacgccatgatcgcgaccagcaccaccagcccaacggccagtacggagcttgagaacaggaaaccttcgtccgagggaatgttcatgaaggtcggcaacccgacatacagcaggtagacggtgtagcagatggcggccgtgccgacgatcatgccgagccacatgtgcggatacagcgccgccaggccgccgatgaacaggggcgtcgcggtataggtggcgaacgcgatgcagcgcgccaggctcgggctggcgtcgtaggtgcgggccatccagtggacgaaggcgcccatgaccgcgaccccgcccagcatcgccaggtacgacatgatggtcatccacagcgcgctttccatggtcagcatgaccggtgctcgattgccgatgacccaaccgacctgggtggtgccgataaacgccgaaatcgccggaatcgccgcgagaatcagcgtgtgggtgaggtacatgtggctgatgctttcctcttcgtcgccacgtatttctcgccattcctgatcggggtgggtgaagagtcccacgacatgatgaatcatagtcagtcactcctttgttattgccatcgccccccaacggagcgcctacgggccagcggccaagtaagtaaaggtctgaatacgtgtgcgaccttatgtcgcagtatagaaaggactgacttgcaaaggtcatgggcgttagagcaaatcgcgctgtcggcgcggctggtaatcgcattcggcgatttgatcggtcggctggcgcccggcgcttcgcccgcgcgcggtttttgcgtaaaatgaccggcttttcgtcacacaccgcggatttcaagcgccatgggcactcttacggtcaaccagaacaaactgcagaaacgcttgcgccgccaggccggggaagcggtcgccgacttcaacatgatcgaagacggcgacaaggtcatggtctgcctgtccggcggcaaggacagctacaccatgctcgacgtgctgatgcacctgcagaaggttgcaccgatcaagttcgacatcgtcgccgtgaacatggaccagaagcagcccgggttccccgagcacgtgctgccggcctacctcgagacactgggtgtggagtaccacatcgtcgagaaggacacctattcggtggtcaaggaactgataccggaaggcaagaccacctgctcgctgtgctcgcgcctgcgtcgcggcaccctgtacaccttcgccgacgagatcggcgcgaccaagatggccctggggcaccatcgcgacgacatcgtcgagaccttcttcctcaacatgttctacaacggctcgctcaaggccatgccgcccaagctgcgggccgacgacgggcgtaatgtggtgatccgccccctggcctattgcagtgagaaggacatccaggcctattccgacctcaagcagttcccgatcatcccgtgcaacctctgcggctcccaggaaaacctgcagcgtcaggtggtcaaggaaatgctccaggaatgggaacgcaagaccccgggccgtaccgaaagcattttccgcggcctgcagaacgtggtgccgtcgcagctggcggaccgcaacctgttcgacttcaccagcctgaagatcgatgaaaccgcggcttcgcgtttcgtcaatgtggtgaacctctgagtcgtctcgcggctctgtatcgtggaatcacggcgctccttcgagcgccgtttctttatcgtcattaggagagggcatgcgcgattacaagtggctgcacgaatactgtctgaaccgcttcggttcggcggccgagctggaagcccatctgccggtgccgaaaaccccggcgcaattgcgcaagatcagcgatgaccgttacctctcgaccctggccctgcgggtattccgcgccggtttgaagcacagcctggtggacgccaagtggccggccttcgaagaggtgttctttggcttcgacccggaaaaagtggtgctgatgggcgccgagcaccttgagcgactgatgcaggacacgcggatcattcgccacctgggcaagctcaagagcgtgccgcgcaacgcgcagatggtgctcgacgtggaaaaggagaagggcagtttcggcgccttgatcgccgattggccggtgaccgacatcgtcggcctgtggaagtacctggccaagcacggtcaccagttgggcggcctgtcggccccgcgctttctgcgaatggtcggcaaggacaccttcgtgccgacctatgacgtggtggcggcgctgaatgcgcagcagatcatcgacaaggtgcccagcagcctcaaggacctggccaccgtgcagggcgccttcaaccagtggcacgccgaaagtggccggccgctgtgccagatctcgatgatgctggcgtatacggtcaatcactgatcggggcgtgttccctggagtaccgcgtcatcgttcatcgcgagcaagcttcgctcctacagaagtactgggtgctctgtaggggcgaggcctgcccgcgatagcgcgccgtcaggcggcgctgacctggccttcgcccgccagcttgcggttgagctggaagcgccagcgcacgtagagcagggccgagcagaacacggccaggctggccagcatctccaggatgccgaacagttgccggttcgggtcgtaggcggccagcgcgcccttgatgaaatacaggttcaccacgaagcacatccaggaatgcccgcgcgcgctgcccaccagcatgcccggcgccatcaacagcagcggcaccagttcgatcagcaggatcacccagggccgggcgccgtgcaggtcggcgacgaacaggtagtagccgcagagcaggccgaccaggccgaaaaagcagatcaggctcagcatccgggtgatgcgtacgcgcggctccagccattcgatggccggcaggatcttcggctttttagccacggctgctctccagttgcagggcagtcttggccaggcgcaggcccagggcgcgacagagggcgacctcgtgctcgttcagcgggctcttgccgtcggcgccggcatggtggctggccccgtaaggcgtgccaccgccacgggtttccagcagggccgactcgctgtagggcaggccggtgatcagcatgccgtggtgcagcagcggcagcatcatcgacagcagggtggtttcctggccgccgtgcaggctggcggtggaggtgaacaccccggccggcttgcccaccagggcgccggtcagccacaggttgctggtgccgtcgaggaagtacttcagcggcgcggccatgttgccgaaccgggtcggactgcccagagccaggccggagcagtgcttcagatcatcgaggctggcgtacagcgcgccgtcttccgggatgctcggggccacggcctcgcagtcggcggatatcgccggcacggtgcgcaggcgcgcttccatgccaccttgttcgataccccgggcgatctgccgggccatctcgttggtcgagccgttgcggctgtagtagagaaccaggatgtacggcgtactcaaggcaggatctccagcacgttctccggcggccggccgatgatggccttgtcgccgacttcgagaatcggccgttccatgagtttcgggtgcgcggcaatggcggcgatcagctgtgcttcgctcaggctggcgtcggccaggttgagggtcttgtactcgtcttcgccggtgcgcagcagctggcgggcgccgatcccgagcttgcccagcaggttttgcagctggacggcatcgagcggggtttccaggtagcggaccacggtcagggtcaggccacgggcttccagcagttccagcgcaccgcgggatttcgagcagcgcgggttgtgataaagcgtcagatcggtcatgggcgggtcgcatcttgcgtaaggtggcggctattctacctgtgcgacgggcagtcctgaaccttgcgaggcgatgggtcgcacgagaaagcgggtttgacgggtttttttcaatacaaggatcaaggcatggcaaggcaactggcagcggcattggcgatcatcggcactttgttgctgagcggctgcggtaacgattacggggtcgatcaatatggccggaaagtcgccgccgagcgcgtggacaaacagtggctggtgctcaattactgggccgaatggtgtgggccgtgccgcaccgagattcccgaactcaatgcattggccgaagggctcaagggccagccggtgagtgtgctgggggtcaatttcgataacgtccagggcgaagaactgaagagcgccagtgaaaaactggggatcaagttcaccgtgctggcgcagaacccggcggagattttcgacttgccacgcagcgaaggcttgccggtgacctacatcatcgatgaccagggcaaggtgcgtgagcaactgatgggcgaacagaccgcggcgggcgtgatggcgaagctggaagccctgcgcgggcattgatctgtagccgctgccgcaggctgcgatcggcctgcaaggccgttgcgattgaaggtcctacggaccttatcgcagcctgcggcagcggctacagggggcggtatcaaccttcctcgagccaccagcgcaatggcttgccttcggccggccagaagcgcacttgctcgattggggaaatgtcccagcgctggacggtttccagcgcctgcaggaagcgtcgttcctgctccatcagggctggcgcgcacagcttgcgggtgctgccgaccttgccgaagctgagcttgtcgccgtccagggtatagggcgcgaaccagtggttgcagccgccgttgccgtaggcgcgaccgtcttcaccgagggtgatggtcaggtggctgtagtcgatcagcggacgctcgccgatccactccaggatgtagctgcgatcctgctgtagtttcaccggctccgccgcgcaacccagcaggccggcgccgaacgcggcggtcaacgccaggcgtttcattgggcggctcgctggcatttcgggcagaggtgtttttccccttcgctgatccagcccagctcggcgatccgcgcgctggccgcgagcttttgcgccttgttgcccagcttggcatccaccgcgaactcgaagctcagctcggccgcgcagctgtcgcagttgacttgccactgatggatcgccagctcgccgaataccggaccacgggccacggcgacccactggccgaccgggttgatcaggtgccgcacggtttccaccgtcaggcgcatcgacaggtccttgctgcccttgagggtgacgatcagcacgtcgtcgttgcggatggaaccaccgttgccggtgacctgatagcggccgggcaccagggcgcggcattcgatcagggtgtgttgcgggttcatcaggctgtagcggaaatcgtgttcgaccatgggtcctccaaatctggcgcgtatgctagcacgcaccccgatacctcaggttgcaggcagatgaccttcgcttaccgccggtccgtcggctcagccttccacctggttgctgggcgcgccggcggcccaggcggcgatgttgtgcaaggtggtgtcggcgatcgccgccagggcctcgcgggtgaggaaggcctggtgggcggtgacaatcacattggggaaggtcagcagccgcgccagcacgtcgtcctgtagcggcaggtcggagcggtcctcgaagaacagctgcgcctcctcttcgtagacatccagccccaggtagcccagctggccgttcttcagcgcctcgatcagtgccggggtatccaccaggccgccacggccggtgttgatcagcattgcgcccggttgcatccgggccaggctctggcggttgatcaggtgtttgctgtcagcggtgagcgggcagtgcaggctgacgatctgcgcctgggccagcagctccggcaggctcaggtaacgtgcgcccagggcctcgacttgcgggttggggaagggatcgtgggccagcaactggcagccgaagccggccatgatccgggcaaatgtcgcgccgatttgcccggtgccgacgatgccgacggtttttcccaccaggtcgaagccggtcaggccgtgcaggctgaagtcgccttcgcgggtgcggttgtaggcgcggtgcaggcggcggttcagcgccaggatcagggccacggcatgctcggccacggcatggggagaataggccgggacccggaccacgctcaggcccaggcgtttggccgcggccaggtcgacatggttgtagccggccgagcgcagcgcgatcaggcgcgtgccgccggcggccagttgctccagcaccggggcgctcaggtcgtcgttgataaaagcgcagaccacctcgtggtgctccgccagggccgcggtgtccaggctcaggcgcgcggcctggaactgtagctcgatgcctggcggcagctcggcgccgaggaagctgtcgcggtcatagttctggctgctgaagagaatcgtgcgcatggcgtcgtccttgtgggaggttgccccgagcatgaaccttcgaggcaaacctgtcgttgccctgggtcaggcgttgatgcgggcctccgtggccagacggttgatggcccgttcgagttcgtcgagggcggcgaaggccttgacgtcttcctgcttgagcagggtttcgctgcgctggcaggcggcgcgcaactgcggcacgccacagtagcgggtggccccgtgcagacggtggacccgttcgatcagcgcattgtggtcgttggcggcacgggcggcgcgaatcgcttcacggtcggcctccagcgaggccaggagcatcgccagcatgtcggcggccaggtccgccttgccggcggccaggcgcaaaccttcgtcgtgatccagcacttgcagctcgaggccgttgccggacggttcgccagtgcgttccggcccctggttgcgcagggccagaccggtccacttcagcaccacctgagccagttgccgctcactgatgggcttggtcaggtagtcgtccatgccgctttgcagcagcgcgcgtttttcgttggccatggcgtgggcggtgagggcgatcaccggcagcggcgtgcagttgcgctcgctctcccactggcgaatcgcctcggtgctctggcggccgtccatgccgggcatctgcacgtccatcatcaccaggtcgaacgattcgttctgcaccgccttgaccgccgcatagccgctgtcgaccgcgagcaccttggcgcccatgtcttcgagcagggtctgcaccagcagcaggttggccgggttgtcatcgacacacagcacccgtggcgggcgactggcgatcggttcgctcggctcgttgcgcaccaccttggggttgaccagatcggccagggcgcgccgcagtttgcgggtgcaggccggtttggcctgcaactggctgtgagggttgggcaccgacagatggaacagcgtctgttcggtggtcgggcacagcaccagcactttgcagcccaggtgttcgaggtcccagatgtgctggttgaggcgttccggcggcatgtcattgctggtgatgccgagcaccgccagatcgatcgcctgttcggtctggtgcactccggtcacgccgttggtcagggcttccagggtattgaacggcgtcacttccagaccgcagtcctcgagttggtgctgcagggcctggcgtgccagctcatggttctccaggaccgcgatccgcctgccgagcagcggcggggcgggcaggtcttcggcgtcgtcgcgggttttcggcaggcgcaggctgatccagaactccgaaccttcgccgggcgtactgtcgacgccgatctcgccacccatctgttcgatcaggcgcttggaaatcaccagccccaggccggtaccgccaggctggcgcgacagcgagttgtcggcctggctgaaggcctggaacagggcgcgcacgtcctggttcgacaggccgatgccggtgtcctgaatgctgatgcgcagttgcacgctgtcttcgtgttcttcttcgagcatggcgcgggcgacgatggtgccttcgcgggtgaacttgatggcgttgctcaccaggttggtgaggatctgcttgaggcgcagcgggtcgcccaccagcgacagcggcgtatcgcgatacaccaggctgaccagttccagctgtttggcgtgggcggccggggcgaggatggtcagggtgtcctgcaacaggtcgcgcaggttgaacggaatactgtcgagcaccagcttgccggcttcgattttcgagaagtcgagaatttcgttgatgattcccagcaggctgtcggcggacttttcgatggtgcccagataatccagctggcgcggggtcagttcgcttttctgcaacaggtgggtgaaaccgaggatgccgttgagcggtgtgcggatttcgtgactcatgttggccaggaattccgacttgatgcggctggcctccagggcctccttgcgcgccagatccagttcgatgttctggatctcgatggtttccaggttttgccggacgtcctcggtggcctggtcgatgctgtgttgcaattcttcctgggcgttctgcagggtgccggccatgcggttgatgcccgaggccagttcgtccagctcctggctgccgagcaagggcaggcgggtttccaggttgccgtccttgagttgggtaacggcatgtttgatctggctcagcgggttgttgatggtgcgccccatgcgcagcgccagcaggccggtgcagatcagcccggcgataatcagcagcaggctggcgaacaggctgcggtagccgcgcaacagcatgctgttatgggacagctccagctcgacccagccgagcaggcggtcggactcgtcgggaatcaggtcgccggccaggttgcggtggcggccgaacaccggcagcagatagcgggtggcgtcgctgccggtgcgttgcagcatctggctgccgttaccggtcggcgcctggttgagcatgctcgggccggcatgggccaggggcgtgcggtcgggcgcgaggaaggtcactgcgcgtacgtcctgctgttccagggactgggtggcgatgcgttccagcagggcggtgttcttgtgggccagggccggtgccaccaggggcgccagttgctcggcgatcatttcgccgcgttgcagaagctgggtttgcaggtccgactgctgcatccaggtgaaataaccgcccagcaccaacgccatcaggctggttggcagcaaggtcagtaacagcacgcggcctttgatccccagtttcttaagcacgcaactctcctgctaccacgccgttttgaatgaaccctgcgcacatccggtgcgcaccacctgcgcagtgtagccatttgctttgccgcaatcttcgcaaaattaaccgtcgaaccgctcaggtgccgcgggctggcgagcgctttgtcgaccggtgtcggttgcccggccgcggacaatcttgaataatcgcccaactgagaattacttgcagaagctaatgaatcccgtatctgtcggccatccccggatcctgagtatcgaagacgacctggtgctcggtgcctatgtgcacgagcaattgggccgttgtgggtttgatgtgacctggtgccagaacggccaggaaggcctgacgatggctcgccagcaacctttcgatgtggtgctgatggacatcctgctgccggggatggacgggctgacggtgctcacccattttcgccagagccattccacgccggtgctgctgatgtcggcgctgggggccgaggccgatcgcatcagcggttttcgcctgggggccgacgattatctgcccaagcccttcagcatggccgagctgcgggtacggatcgaagccatcctgcggcgcgtggccctggatcgccggccggccccggcgccgctcaggcaggaagcccaggggctgcgtttcgacgacgagctgtgcgacgtgcattacgggcaacaatgggccgggctgacgcgcagcgaataccgcctgctggagacactcaaccgcaacggcgacgaggtcctgagcaaacccttcctttatcagcatgtgctgcagcgcggctatgcgccccatgatcgcagcctggacatgcacatcagccagatccgccgcaaactcaaggccgtcggttatggcgcgcgggaagtgcgcacggtctggggcaagggctatgtgctgagtgccgtcgatgaaatggcctgagctgcccggcaggcattcgctgttctggaagctggcctgcctgttggtcgcgttctgcctgctgatgatctggctgagctggtcctggggccgctacatggaacagaagaacctgttcctttccgacgaggcccgcggcacgctgaccggctacgccgccgaagccgaacaggcctggaaccaggggcagagcgccggggtcgatgcctggctgcagggcatggccgagcgcgagcgccattgggtcggggtcatcggccgcgacctgcaatcgctgagcagctatccgctgagcgaagccgagagccagcacctgacatccctgcgcggcctggattggccggtcagccggcatacccgtggtttgccctggctgaagattgcgtttcccaacgacccgtccgccggcagcctggtgatcgagttgccccagcgcttcatgcctgggcgctaccgggtgttctggcgggtgctgaccaatggggtgattcccggcctgttcaccctgctgctgtgtgtcgggctgtatcgactgctggtggtgccgctgaaccagctgcgcgaacaggccaacgcctggcgcgccgatcaactgaatgcgcggctgtcgagccagaccaccagtcgccaggacgagttgggcgagctgggtcgggcgttcgaccagatgtccgagcgcctgcagggcaccgtggccttgcagcaacaattgctgcgcgatctttcccatgaattgcgtacgcccctgagtcgcctgcgggtggcctgtgacggcgagcagagcctgccggcactgcgtgagcggctggcacgggaggtcgatggcatgcagcggctggtggacgacaccctgcaactggcctggctcgacaccgagcgggcaccgctggccgaggaagacatccagatccaggccctgtgggaaatgctcacggaaaacgcctgtttcgaaagcgcctggtccagcgcacaactgcactgtgcgctggacgcttcatgctgggtccggggcaacctcaataccctggcccaggccctggaaaatatcctgcgcaatgccattcgtcattcgcccgcgggcggtcgtgtgctgctggacggccagcgccagggcgagcattggttgctgtggctggaggatgaagggcctggcgtggccgacgccgatctgcagcggatcttcgacccctttacccgcctcgacggctcgcgcccgggccatggtggttttggcctggggttgagtattgcgcgcaacgccgtgcagcgtcagggcggccagctgtgggcggaaaataccgggcgtgggctgcgtttgaacatgcgcctgcgggctgccgttgtgatggacgcgccttcgcccgaggctgattcgctgccttatatcgttaagccataagaccctcactttgcgtgatatggtctgcgaacgtttgccggtatgatagtcgcccccgcagtccggattgcgaatacgccatgaccttgcagtaccccaccatcgccgattgcgtcggcaacaccccgctggtccgtttgcagcgcctgcctggcgtcaccagcaataccctgctgctcaagctcgagggcaataacccggcgggttcggtcaaggaccgcccggcgctgtcgatgatcactcgcgccgagctgcgtgggcagattcaccccggcgatacgctgatcgaagcgacctcgggcaacaccgggattgccctggccatggccgcggcgatcaagggctacaagatgattctgatcatgcccgacaactccagtgccgagcgcaaggcggcgatgaccgcctatggcgccgaactgatcctggtcagccaggaagagggcatggaaggcgcgcgcgacctggccgaaaagatgcaggccgaaggtcgcggcaaggtgctcgaccagttcgccaacggtgacaaccccgaggcgcactacaccggcaccggcccggaaatctggcgccagaccgagggcaccatcacccatttcgtcagctccatgggcaccaccggcactatcatgggtacctcgcgttatctgaaggaacagaacccgaacgtgcagatcatcggcctgcaaccgatggaaggctcggccattcccggcattcgccgctggccgcaggaatacctgccgaagatctaccaggccagtcgcgtggatcgcatcgtcgacatggcgcaaagcgaagccgaagacgtgacccggcgcctggcccgcgaagaaggcatcttctgcggcgtgtcctcgggcggtgcggtggcggcgatgttgcgcctgtcccgcgaagtcgaaaacgcggtgattgtcgcgatcatctgtgaccgtggcgaccgttacctgtcgaccggcatcttcgatgcgcccaactgatggctaagccagtcagaggcctgcgcttccagccttcgggcggcagccgggctgcgcagatacccgtcgggaaaaaacagcgcctgaccatcgagcgcctggccaacgatggtcgcggcattgccttcctggaaggacgtacctggttcgtcgctggcgcattggcgggcgaagaggtcgaggcgcgcgtgttgggcgcccacggcaaagtggtggaagcccgtaccgagcgggtgttcagcgccagcgatttgcggcgcccggccccgtgcgcccatgccggccgttgcggtggctgcagcgtgcagcatctgccccatgacgaacagcttgccctgaaacagcgcatgctcgccgagcagctgtcgcgggtcgccggtgtcgagccagaggcatgggcggcgcccttgagcggtccggagttcggctaccggcgccgggcgcgggtcgcggtgcgctgggacgccaaggcgaaaaagctcgaagtgggttttcgcgccgccggcagccaggacatcgtcgccatcgacgaatgcccggtgctggtacagcccttgcaaccgatcatgagccgcttgccggccatgctgcagcgcctgagcaagccgcaggcactggggcacgtggaattgttcagcggttcggcgattgccgtgctgctgcgccatatggcgccgttgtccgcggccgacctggagattctccaggcgttctgcgcattccatgaggcccagttgtggctgcatggcgaaggcgagccgcaaccggtggacccggaccaggccctgggctatcgcctggagccctggaatctgcagctggcttatcggccgggagactttgtccaggtcaacgccggggtcaacgaggcgatggtggcccaggccctggagtggttggcgccacaggccgacgagcgcgtgctggacctgttttgcggcttgggcaactttgccttgccgctggcgcagaacgttcgggaagtggtggcggtcgaaggggtggcgaccatggtcgcgcgtgccgcggagaatgccgctagcaacaatttgcataacacccggttttttcaggccgatttatcgcagcccctgagcgacgccgagtgggcccgcgaaggcttttctgcggtactcttggacccacctcgggacggggctttcgaggtggtccgcaagctggcgagcctgggcgccaagcgcctggtttatgtgtcatgcaaccctgccactctggcgcgtgacacagtcgaactggtcagacagggctaccggttaaaacgtgccgggatcctcgatatgtttcctcagacggcacatgtcgaggccatggcgttatttgaagcgagctaggatggctcgtctaatccgttggcccgtcaggcagcactcgccggcccagcgaggaaatactggcagtgaaggtcagcgatttgacgcattgaatgtgcgtcgtagggaaggtaaagcaagatggtacaggtgagagcgcaccagccgatcaacaccgacggcagtatcaatctcgaggcgtggctcgatcatgcggtcagcgtcgacatggcactggaccgtgaagccttgaaagaagcctgcgagttcgctcgtgaggcagagcaacaacacatcgcggcgaagaatctcagcggcgaggacatgtcgagtttcagcactggcctggagatcgcggagatcctcgccgacctcaagctggatcaggattcgctggtggccgcggtgctttaccgtggcgtccgggaaggccagatcccgctgccggccgtcagccagcgcttcggcccggtggtggccaagctgatcgacggcgtgctgcgcatggcagcgatcagcgccagcctcagcccccgccaatccctcgtgctcggcacccaggcccaggtggaaaacctgcgcaagatgctggtggcaatggtcgatgacgtgcgtgtggcactgatcaagctggccgagcggacctgcgcgatcagggcggtgaaaaacgccgacgacgagaagcgcaaccgggtcgcccgggaagtcttcgacatctatgcgccgctggcgcatcgcctcggtattggccatatcaaatgggagctggaggacctgtccttccgctacctggagcctgagcagtacaagcagatcgccaagttgctgcacgagcggcgccttgatcgcgagcgtttcatctccgacgtgatgaaccagctgcagaacgaactgcgggccaccggcgtcgacgccgacatcagcggccgggccaaacacatctattcgatctggcgcaaaatgcagcgcaagggcctggagttcagccagatctacgacgtgcgcgcggtgcgcgtgctggtcccggaaatgcgcgactgctacaccgcgctggggatcgtccacaccctgtggcggcacattccgaaagagttcgacgactacatcgccaaccccaaggagaacggttaccgctcgctgcacacggcggtcatcggccctgagggcaaggtcctggaagtgcagatccgcacccacgcgatgcacgaagaggccgagctgggggtctgcgcccactggcgctacaagggcaccgacgtcaagtccggttccaaccactacgaagagaaaatctcctggctgcgtcaggtgctcgagtggcatgaggagctgggggatatcggcggcctggccgagcagttgcgggtggatatcgagccggaccgggtctacatcttcacccccgacggccacgccatcgacttgccgaaaggcgcgaccccgctggacttcgcctaccgcgtgcacaccgagatcggtcacaactgccggggcgcgaagatcaacgggcgcatcgtgccgctcaactacagcctgcagaccggcgagcaggtcgagatcatcaccagcaagcacggcacgccgagccgcgactggctgaacccgaacctgggctatgtcaccacctcgcgggcgcgggcgaagatcgtccactggttcaagctgcaggcgcgggatcagaacgtggcggcgggcaagaccctgctcgagcgcgaactcaatcgcctcgacctgccgcaggtggatttcgacaagctggccgacaaggccaacatgaaaaccgccgaggacatgttcgcggcactgggcgcgggcgacctgcgcctggcgcaactggtcaacctggctcagcagttggtggagccggagcgcggcaacgaacagctggagctgatcccgcgcaaggccaccggctacaagcccggcaagcgcggcgacatccagatccagggcgtcggcaacctgctgacccagatggccggctgctgccagccgctgccaggggatgcgatcgtcggttacatcacccaggggcgcggggtgagcattcaccgtcaggactgtgcctcggtgctgcaactggccggccgcgagccggagcggatcatccaggtcagctggggcccggtgccggtgcagacctacccggtggacatcattattcgcgcctacgaccgctccggtttgctgcgtgacgtgtcccaggtgctgctcaacgaacggatcaacgtgctggcggtcaacacccgctcgaacaaggaggacaacaccgcgctgatgtccctgaccatcgagattccggggctggacgcgttggggcggttgctggggcgtatttcccagttgccgaacatcatcgagacccgccgtaaccgtaccccttgaagatggcccgatactgcgggagcaagctggcttgcttccgcagggggcgctaacgagagtgaccgatgtacagccttgaagacctgttgcacctgatggcgcggctgcgggacccgcagtacggctgcccttgggatatcaagcagagctacgccaccatcgtcccccacaccctggaagaagcctacgaagtggccgacgccatcgagcggggcgatttcgagcacttgcagggcgagttgggcgatctgctgttccaggtggtgtactacagccagctggcgcgggaggaggggcgtttcgagttcgatggcgtggtcgacagcatcacccgcaagctgatccgtcgccatccccatgtattccctaccggggacctgtatgcgccgctggataccccgcggctggatgaagaacaggtcaagcagcgctgggaagagatcaaggccgaggagcgcgccgagaagtcggcagagcctttgcagttgtccttgctcgacgatgtgcccacggcgctgccggcgctgtcccgttcggccaagttgcaaaagcgcgcggcccaggtcggttttgactggccggatgccttgccggtggtggacaagatccgcgaagagctcgatgaagtgctcgaagccatgtccgagaatgacccgcaggcgatcgccgacgaggtgggcgacttgctgttcgccgtggtcaatctggcccggcatctgaaggtcgatccggaaaccaccctgcgtggcgccaatgccaagttcgagcggcgctttcgatttatcgagcaggcattgcgcgatacccgccgacccatggaagattgcatcctcgaagagttggacgccttgtggggcgaagccaaacgtcaggaaaagaatttgcccagctgtggctgaggctgttgcctaagtgagtgagcaccaatgagcctttcccttcgcgaccagttgctcaaagcagggctggtcaaccaaaagcaggccaaacaggtcagcaaagagaaacagaagcagcaacgcctggcccacaaaggccagatcgaactggacgatacccagcagcgtgcggcccaggaagccatggccgagaaggtcaagcgcgaccaggaactcaaccgccagcagcaggagaaggccgagcagaaggcccgtgccgcgcagatcaagcaactgatcgaagtgtcgcgcctgccgaagctgaccaccgaggactactacaatttcgtcgacgacaagaaggtcaagcgcctgtcggtgaacgccctgatgcgcaacaagctgagcagcggctcgctggccatcgtgcatcatgccggcggttatgaggtcatcccgcgtgaagccgcgctgaagatccaggagcgcgatccacggcgcatcgttcagctcaacacgccgaccgaggcgccggacgaggacgatccgtatgcggcctaccagatccctgacgatctgatgtggtaaacctgcataaacaacaaaccccgccatgagcggggtttgttgtttctgaagcgcctgccgatgcgtggcggcaggcgcggcagtcatcgtgaggtcaggagctttgcggtgcgcggttctgctccagcttctccagttcggccttgtaattatgggcatcggtctcggaatgaaacattcccaccagcaagtcttgttgatgcacgtcccagatccgtacacctgcggctacgccttcatgggacatgtgtgaatcgtcgcgttcagttacttttacagtcatctgctagctccaatctctattgatctgcagcaaggcgtgtgcaggactccgttatatattttgttagctggctaagtaaattgctttcaaatgcaacaatcttttgcagatttcgaaacagtcccgcaggccgcggaaactgtggcattcggtcgcaggtatcggagtttcatgacaaaagtttcatgttgggcggctgtcgtgctgggtatttttagccggcgagcgagcctgtcaggtcgccaggagagccgtgcttgagcggctaaatggaaacaccaggcgaaaaaaagccccgcatcggcggggctttttattgtcgtgcggcttagctacctttgacggtcttgccgttgacggtgccgttcaggagcatgatgttgtactccttgccgtcggtttcgacctgttgcaggcgaaccagcaggtaatcccagtccttggcgaaccacatgacggtgatgcgtttgctttgtgtcgggtcgcgcacgcgctcgaccttgatcgcatcgatctggccggccttggtgtcgactttttccgagcccaggacacggaagtcgtaggtatcgacttcgccatcatcgacgacctggtagctcatgcttttcttgccggcggctacatcgtgctgcagggcgagctggtaggtggatttgtcgaccatgccgcgattgagcgggatcttgaccgcgtcaccacgatcggtgccagtgaccatcttggcgttccagtcgaagtccaggtcggccttcttggctttgcccaggccgccgcgctcgaagtgataggactgcggcagcagggtgtccttgtcgagcttcagggtgctttcttcggtcaggctggcgatcatcatcgaggccttgaagctcagcttccaggtgccgtcgcctttcttttccaggctgcgttcggcggtaccgctcatcggcagctgtttccagtcggcggtatagctggcggagaagggttgaaggtccgcagcctgcgcgaagggcagggcgagcagagcacaagcgaagagcagggcgcgacgcataaaatctcctaattacgaatcaagtggccactggcggccagtaactgaccatccagtaaagcaccctgttcgccgagtgtgagtcgaccttcggcaaaccagcgtacggccatcgggtaaatccggtgttcctggacgtggacccgctgcgccaggctttgcggcgagtcgtgcaactctaccgggatcactgcctgtacgaccagtggtccgccatcgagttcctctgtcacaaagtgcacgctgcagccgtgctcggtgtctccggcctccagcgctcgctgatgagtgtgtaaccctttgtatttgggtagcagcgaagggtggatattgagcaggcgaccctgatagtgccgaacgaaatccgcgctgagaatgcgcatgaatccggcaagcaccaccagcttgggctggaaggcgtcaatcagttcgatcagcgcggtatcgaaggcctcgcggccttcgaatgccttgtgatcgagggcgcgggtatcgatacccgcgtcccgggcgcgttgcaggccgtaggcatcggcgcgattggaaatcaccgcgcggatgcgcaccgggctgtcatcggccagcgtactgtcgatcagggcctgcaagttactgccggtaccggacaacagcaccactacatcacaggtggctgacatcggctcttgcatcaatgtgccttgaggtttttcagctcgacctgggcagcgccctcggcggcgctagcgatctgaccaatgacccaaggttgttcgccggcttcgcgcaggacgttcagggcgctttcaacgtgctcctgagccacgcagatcaccatgcccacgccgcagttcagcacgcggtgcatttcgtgttcgtcgacgttgcctttctcttgcagccagtcgaataccgccgggcgctgccagctggccacgtcgaccacggcctgggcgccttttggcagaacgcgcgggatgttgtccagcaggccgccgccggtgatgtgggccatggccttgaccgcgccagtgtccttgatcagcttgagcagtggcttgacgtagatgcgggtcggggccatcagcagttcggtcagcggcttgccgtcgagctggacggtttcgatgtcggcaccggagacttcgatgatcttgcggatcagcgagtagccgttggagtgcgggccggacgatggcagggcgagcagggcgtcgccggtggcaaccttggaaccgtcgatgatttcggctttttccaccacgccgacgcagaagccggccaggtcgtagtcttcaccttcgtacatgccgggcatttcagcggtttcaccgccgaccagggagcagccagccagttcgcagccagcgccgataccggtcaccacggtggcggcaacgtcgacgttcagcttgccggtggcgtagtagtcgaggaagaacagcggctcggcaccgcagaccaccaggtcgttgacgcacatggcgaccaggtcctggccgatgctgtcgtgtttgttcaggttcagtgccaggcgcagcttggtgcccacgccgtcggtaccggagaccagtactggctgcttgtagccggccgggatttcgcagagggcgccgaaaccgcccaggccgcccatgacttccgggcgcgcagtgcgcttggcgacgctcttgatgcgttcgaccaatgcttcaccggcgtcgatgtctacaccggcgtctttgtagctcagggagggttgcttgctcatgatccaggcctttaggggggattcagggggtatcgaccgagtccagggaggccagtgaaacagtcgcggcggcaatgccgcgcaatcatttcagcgaccccggctgttgccggtctgcgaaggcgcgcgattttatcaggcttgaggtgtagcggccatcctcgggccgacgggcagggcatatccgcttaaaaaaaaccgcaattgcgcgtgtcgatcgcgccgctcggggctgtataaggtatagccttgtacccgctatcgttatgacagcacgaaaacttccatcgaccgggtgaatgtttgcccaggctttgtggtcacagccttggtcaatcctgttcatgcggtctgttccagccgccttttgtcgtcgggaatcctccatgcgtttggataaatttctttttgtgggctgtttgtctttggtcagcctggcgagtcatgccgaaaccctcaataacctgtatcaggtccgcgaaccggtcagcagccaggcccctggcgagcgcgaccaggctacccagcgggccctggaaaccctggtattgcgcctgactggcgatagcaaggccctgcagaatccgggactggcggccatccgcaaggacccgcagcagatcatcagccagtacggctacgacgccggtcctcccgaaagcctgcaggtcgacttcgatccggccagcaccgaccgggcgttgcgccaggctggcctgtcgttgtggggcagcaatcgcccgtcgattctcggctggtggctgaccgactccagtgaaggttccagcctggtgggcgatggccaggccagcgccacgccgttgcgccgtgcggccctgcaccgcggcctgccgctgcgtttgccgctgggtgacctgaatgagcagattgtcgccacggcgccgaatctcgaaggttccgatccggcgccattgcgcgccgcgtcggagcgttacggcgcggacgccctgctggcggtgcatgccagtgaagagggcggtcagtggcaggccaaatggcgtctgtggctgggtgaccagaaggaacagggcagcgtccagggagctgatgtgccggccttggccgatgccgtgctgttggcggtcagccagcgcctggccccgcgtttcgcggtcaagccgggcgcctccagcgagcagttgctggaagtgcagggcatgaacctggagcgctatgcggcgttgggccgtttgctcgagcccttcggtgggcgtttgcagagcgtcgatggtgaacgttcggtgtaccgggtcagcggcagcgccgagcagttgcgtgcgcagttgaatctggctcggttgcaggaagtcccggcgggcgctgtgcctgtccagccgactgtcgaaggcgcgacacccgcgcctgcaccggccgcgcaactgcgttttcgctggtaggttttctttctttatatagaaacaatggagtggttcatggctgatacgcgtcgatgggtctggttgggtgggttggtcctgctctgtggatttgtgtacctgttgcatccgatcctgacgccgttcctggtggccttgctgttggcctatctgttcgatccgctagtggaccgcctggaaaagctcgggctgtcgcgcacctggggcgtggtggcggtatttgccctgttcaccctgattgtcatggcgttgctactggtgctggtgcctatgctcgccaagcagctgctgcgcctgtacgaactggcgccgcagatgctcgattggctgcagcacacggcaatgccctgggcgcagtccaagctgggtttgtccgatggtttctggaagttcgacaaggtcaaggcggcgatcagcgagcacatggggcagaccaccgatatcgtcggcgtggtcctgagccaggcaacggcctccagcctggcgctgattggctggctggccaacctggtgctgattccggtggtcagcttttacctgctgcgcgactgggacttgatgatggcgaagatccgcagcctgttgccccgtgatcgcgaggagcgtgtggtggcgctggcgggagaatgccatgaagtgctgggggcgttcgtccgtggtcagctgctggtgatggtggccctggggatgatctatgcggccggcctgatgctggtcgggctggaactggggctgttgatcggtctgattgccggcctggcggccatcgtgccgtacatgggatttgtcatcggcatcggcgcggcgctgattgccgggttgttccagttcggcggcgacctgtacccgatgatcggcatcgtggccgtgttcatggtcggccaggccctggagggtatggtgctgacccccttgctggtaggcgaccggatcggcctgcacccggtggcggtgatttttgcgattctcgccggtggcgagctgttcggtttcaccggcatcctgctggccttgccggtggcggcggtgattatggtgctggtgcgccatgtgcacgacttgtacaaggattcggacatctatagcggtatagaagagtccgagctgtagcgacccctgtttgcattttggggcacccgcgtttcgggcgggtgcctcggagagtctttacagctgtcacatccaccgtcaaagaaacccccgtgatttcatcaggctaacgcaaacctttgattttgcttgtggtctgctacattgtgcgcccggcgtcacgggtataaactttgcaaactttacacagaggccactaacggttcgtttggaactgttcagtcagcatgaaaccgattcagctgcccctaggtgtgcgtctgcgtgatgacgccaccttcatcaactactatccaggcgccaatgccgctgcactcggctatgtcgagcggctttgcgaagccgacgccggctggaccgaaagcctgatctatctctggggcaaggatggggtagggcgtacgcacttgctgcaggcggcctgcctgcggttcgagcagttgggggagccagcggtctatttgcccctggcggaattgctggatcgcggcatcgaaatcctcgacaacctggaacagtacgaactggtctgcctggacgacttgcaagcggtggcgggcaaggctgactgggaagaggcgctgtttcatctgttcaaccgcttgcgtgacagcggtcggcgcctgttgatcgcggcttcgacctccccccgggagttgccggtgaagctggcggacctcaaatcccgcctgaccctggcgctgatcttccagatgcgcccgctctccgatgaagacaaattgcgtgcattgcagttgcgcgcctcgcgtcgcgggctgcacctgaccgacgaagtcgggcactttatcctgacgcgcggtacccgcagcatgagcgccttgttcgagctgctggagcgcctcgatcaggcgtccttgcaggctcagcgcaagctgaccattccctttctcaaggaaaccctgggctggtaaaaccgcgagcagtagtggctttttggcatgtttcaggcgccagaaacccgcatccggaagtggttccagaggcgtgtgcgtttaaaatgggcttaaggccttagatgttgagtagaaaccgataagtcacatttcaatcgattgaatttgcaaattagagcgatagaaggcatagtcgcggcttctttataactttaagccacggtcgtgcccatgctgaagcgcttcgcacccctcgtgcctcttgcactcgttaccctgttgtttggttgcgccacccactctccggtgagccaacaagagcagcaacaggttcaacactcttcaaaagcccagtcttccgctattttccaggaagagctggcaactgaaaaagaactcgccgagtttgctgacaacaagccttaccagctgccagtgctggctgacagtattctcgaacgtggcatgtccctgatcggtacccgttatcgtttcggcggtacctccgaagccggtttcgattgcagcggtttcatcggctacctgttccgtgaagaagccggcatgaatctgccgcgctccacccgtgaaatgatcaacgttgatgctccgctggttgcgcgtaacaagctgcagccgggcgatctgctgttcttcgccaccaatggtcgccgcggtcgcgtaagccacgctggcatctatctgggcgatgaccagttcatccactccagcagccgccgcagcggtggggtgcgggtggatagcctgggcgacagctactggagcaagaccttcatcgaagccaagcgtgccctcgccatggcgccgactgtggtcaccgcacgcaagtaagctgactttttgtaaggtgaagttaaagtcttacttgaagtttggcgcgtagacgctagaatcctgatctattgttgaaaactaaccgcgtaagccctgcttacgcggttttgttttcggcctcacggcagagaaagccgcatccagatcaggattgttctgcatatgtcgacgtcggcccgccttgcattgatcgttctcgccgcgctgctcagcgcgtgcgccagtcgtaccccgccacccgcgcctgtggtacgtgctcccgtattcaatactccccagaccttctcgccggctgccgaagacgtgctgtttcgtgcgttgggcctggtgggcacaccttatcgctggggcggcaacacgccggactccggtttcgattgcagtggcctgatcggctatgtctatcgcgacgccgccggtatctcgctgccgcgctcgacccgcgaaatgatcggcatgcgggcaccgaatgtcggcaagaatgccttgcagaccggcgacctgatattttttgccaccaatggcggttcccaggtcagccacgcgggcatctatgtcggcgaaggccgcttcgtccatgcgccggccaccggtggcacggtgaagctggatagcctgtccaaggcctattggcaaaaagcctacctgagcgccaagcgcgtgctgcagccagagcatctggcgcacaacccttagtcctgtctctgcgtcgaggttgccatgaccgctcgtaccctcaacctcgacgacgccctctatcactacctgctcgacgtttccctgcgcgaaacgccgctgctgcgccgtctgcgtgacgaaactcaggcgctgcctatggcgcgctggcaggtggcacccgagcagggacagttcctggcgttgctgatcaagctgatcggtgcccggcgtgtgctggaagtggggaccttcaccggctacagcgccttgtccatggccgcggccttgccggaggatggtcaactgatctgctgtgacatcccgggcgactacaacgccaccgcgcgccgctactggcaggaagcaggtgtcaccggacggatcgagttgcgcctggcaccggccctggagaccttggccaggatcgagcaggaggagggcgagggtggtttcgacctggtcttcatcgacgccgacaaggccaattacccggcttatctggaaagtgccctgcggctgctacgcgtgggcgggctggcggtattcgataacacgctgtggagcggtcgggtgctggaggaaaatccccagagcgaagacacccgggccatccaggcactcaatcgcgccttgaaggatgacccgcgtgtcgacctgtcgctgctgcccctgggggacggcttgaccctgtgccgcaagcgctgaacctactgcgccttggctgctgacacgcgccagactttgttgccgacatcatcggctaccaacagatccccttgcttgttgatcactacgccgaccgggcggcccatggctttctcgtcggcgctgaggaaaccggtcagcacgtccaccggttggcctaccggcttgccgttggcgaagggtacgaagatcactttgtagccgctgtggggcttgcggttccacgagccatgctggccgatgaacacaccttgggtgaacggtgccggcagcttgctgccttcggcgaaggtcaggcccagggaggcggtatgcgggccgacggcataatccggggcgatggccttggccaccaggtccgggttctgcggggtgactcgcacgtccacatgctggccgtaatagctgaatggccagccatagaaggcgccgtccttgaccgaggtgatgtagtccggcaccaggtcgctgccgatctcgtcgcgctcgttgaccgcggtccacaactggccgctttgcggctcccaggccatgccgttggggttgcgcaggccggaggcgaaaatccgttgcttgccggtggcgcggtcgacttcccagatggcggcacggcctttttcctggtccatgccgttttcgccgacgttgctgttggaaccgaccgtgacgtacagcttgctgccgtctttgctggcaatcacatttttggtccagtggtggttcaacttgccgccaggcaggtccaccaccttggtcggctgggcgctgatcctggtgtcgccgtccttgtaggggaagcgcagcaggcgatcggtatcggcgacgtacaggtcgttgcccaccagggccatgccgaacggcgagttgaggttttccaggaatgccgtgcgggtttccgccacgccatcgtgatccttgtcccgcagcagggtgatgcggttcgggctgggcacaccggccccggcgcggctcatgatcttgctggctatccagccacgaatacctttgctgtcatcgggggagggcggggcgttggtctccgccaccagtacgtcgccgttgggcagcacgtacaaccagcgcggatggtccaggccttcggcgaatgcggcgacctgggtgccggcggcggccaccggtttggcgtcttgcggccagccgatcgcgggcgcgatgtttacggtcgggaacagggtcttgttcggttcgggcagtttcggcgaggggccggtgccgtcggagacctggagggtggaggtttcgccacaggcaccaaggcctgcggcgacggcgataaggattgcgtatcgaggcttgaacatgctgatttccctatgtatgcacgacgtcggtgtagtcatagagaagcacaggtcggcgatggttcaacccgttcagcgcgcttccttgaacagcacggcaacgccggggtgatagttgccggcttcattgcgcaatttgcggtacgcgtaggggaagtaccaggccacggcgcagcaatgttccttttgcaggtcgtcgaccatgtcctgcaattcttccggggtggcgctgtgctgggttttctggggcgtgacgaacaggcagccgagtttcaggtcgctggggtagctggcttttttcgcgtcgctggcggcatccagcaacggttgggtcaggtgcaggctgttgacccggggccagcgctgggtggtctggatatagacgcgttgctcctgcgtggcgatgtacaggtcggtgcggccattgcggtcgccgtcctcgagctgttttttgctcggtgcgtgttccagagtgaccatctccgccatccaggctgccgccgagagcattcccaggttggctttttcgtcgaaccagtacgggctttcgttatcgccgcgcacggcgttgtagcggtcgatgcaatcgaaccagcgttccagagcagggcgcaggaattccagtttcggattgctgatgatcatgccttgcatcggacttttcctattattgttgagatattggagttttttaacgcgattatggctatttgatatcactgcgctgagtgtggcacaagattggcgtcatttttccgatatgcagcattcgccgatctgcggggctttaattgacgctccacccccaaccctctaaccttcgcgacttgtttcaggtgctctgtggccttgggtcgacagagtgaaacagggaagccggtgagtacgcgtgccgaaggcgcacgcacgacgattccggcgctgcccccgcaacggtaagtgagtcaagactgcgcctgatgccactgtgtcgactgtcgacatgggaaggcgcgcagttgggcatcccagccactcacaagcccggagaccggcctgatccatccaacggcatcacggtgggcgatgccaggcttgcgccgtctattcctattcctgccccccgttatccagccccaacggagagctgccccatgactgaatcccccgatcgtgacgaacgccatctggcgcgcatgttgcgcaaaaaagccgtgatcgatgaacgcatcgccaattcgccgaacgagtgcggcttgctgctggtgctgaccggcaacggcaaaggcaaaagcagctcggccttcggcatgctcgcgcgggccatgggccacggcatgcaatgcggcgtggtgcagttcatcaagggccgcaacagcactggcgaggaattgttcttccggcgcttcccggagcaggtgcgtttccatgtcatgggcgaaggcttcacctgggaaacccaggaccgccagcgcgacatcgccgcggccgaagcggcctgggcggtttcccgcgaactgctgagcgatccgacgatcggcctggtgctgctcgatgaactgaacatcgccctcaagcacggctatctggacctggatcaggtgctcagcgacctgcaggcgcggccaccgatgcagcatgtggtggtcaccggacgtggtgccaagccagagatgatcgagctggccgacaccgtcaccgaaatgggcatgatcaagcatgcgttccaggccgggatcaaagcgcaaaaaggcgtcgaactgtgagtgattcccgtcattgcccggcggtattgattgccgcgccggcttccggtcagggcaagaccaccgtgaccgccgcgctcgcccgcctgcatcgcaatcaggggcgcaaggtgcgcgtgttcaagtgcggcccggactttctcgacccgatgatcctcgagcgcgccagcggtgcgccggtgtatcagctggacatgtggatggtcggcgagcaggaaagccgccgcctgttgtgggaggccgccggcgaggcggacctgatcctgatcgagggcgtgatggggctgttcgacggcacgccgtccagcgccgatctggcgcggcatttcggggtgccggtgctcgcggtgatcgatggcacggccatggcccagaccttcggcgccctggcgctggggctggcgcgttatcagccggacttgccgttcgccggcgtgctggccaaccgggtcggcaccctgaggcatgcgcagttgctcgaaggcagcctgaccgaaggcctgcgctggtacggcgcgctgtcccgggagaccggcatcgaactgcccagccgccatctggggttggtgcaggccagtgaactcaacgatctggatctgcgtctcgacgccgcggccgctgctttggcggacagctgcgaagtggccttgccgcccgccgtggcgttcgccgctccccagacggttgccgtcgagccattgttggccggcgtgcgcattgccgtggcccgcgacgaagcctttgcctttacctatggcgcgagcctggatctgttgcgggccatgggcgccgagctgagttttttctcgccgatccatgacgcggtactgccggaggcggacagcctgtacctgccgggcggttacccggagctgcatcaccgggcgctggcggcgaacggctcgatgctcagcgcgatccgtgcgcatcacgctgcaggcaaacccttgctcgccgagtgtggcggcatgttgtatctgctggactccctgaccgacgtcgacggcgagcgcgccgaactgctgggcctgttgcccggcgacgcggtgatgcaaaagcgcctggcggccctggccttgcaggcggtggagttgccggaaggctcgttgcgcgggcatacctaccaccattcgttgaccagcaccgagcttgcgccgatcgcccggggcctgagcccgaatggcgggcgcggcgcggaagcggtttaccgcgaagggcggatgaccgcctcttatgtgcacttctattttccgtccaaccccgaagcggtggcggccctgctggcgccggcaggagcgagcgtgctcgcgcggcgcccatgagcgacaacgccttttccgcggccgaacgcgacgcggtctatcgcgcgatcgccgagcgtcgtgacatgcgccacttcgtcggtggcacggtcgagccgcaggtcttgcgtcgcctgctggaggcggcgcaccaggcgcccagcgtcggcctgatgcagccctggcggtttatccgtatcagtgaccggtcgttgcgcgggcaaatccagcaactggtggaagaggagcgggtacgcaccgccgaggccctgggcgaacgttacgatgagttcatgaagctcaaggtcaaggcatcaacgactgcgccgaggtcctggtggcggcgctgatggacgaccgcgagcggcatattttcggccggcgcaccctgccggaaatggacctggcctcgctctcctgcgcgatccagaacctgtggctggcggcccgggccgaagggctgggcatgggctgggtgtcgttgttcgagcccgctgccttggcccagttgctgggcctgccggccggggccaagccgctggcggtgctgtgcctgggcccggtgggcgagttttacccggcgccgatgttggtgctcgaaggctgggcgcgggagcgtccgctgagtgaattgctgtatgaaaattactggggagtgagtcaatgagtgtggcgttgctgagtgtcgccggggtggcgctggatgcgttgctgggcgaacccaaacgctggcatccgctggtggcgttcggccgttttgccgatcgcatcgagcaacgtttcaactccggcggtcgcggctggcgcagtcatggcgtcaccgcctgggtcatcgcggtgctgccgctgaccctgctggcaaccctgttttcctggctgccctacatcggttggttgttcgagatcctggcgctgtattgcgcccttggcctgcgcagcctcggcgagcatgtcgagccggtggcccaggccttgcgcagcgacgacctggaccaggcgcggcagcgggtcggttatctggtgagccggcagaccagcgagctggatgccaccgaagtcgcccgcgccgccaccgagtcggtgctggaaaacggcagcgacgcggtgttcgccgccttgttctggtttgccgtggccggtgcgccgggcgtggtgctctatcgcctgagcaataccctggatgcgatgtggggctatcgtaatgagcgcttcgagcgtttcggctgggcggcggcgaagatcgacgacctgctcaactacattccagcccgcctggtagccctgacttacgcgttgctgggcaagacccgcctggcgctgaaatgctggcgccgccaggggccgacctgggacagcccgaacgccgggccggtgatggcggccggggctggggccctgggcgtcgagctgggcggcgcggcgatctatcacggcgagctgcaccagcgcccgcaattgggcgaaggcgtggcggccgatgcctcgtctatcgatcgcggctggcaactggtacagcgcggggtctggttatggctgctgattctctgcgtgggagctgagttctatgcttgagcacggtggtcgcctgcgcaaggcggccgagcaatacggcatcgccgaggccgactggctggacctgtccagcggcctggcaccctggccgtggccgattcccgagatcgggatgcgggcctgggcgcgcctgccggaaaccgacgatggcctggagcaggcggcccgcgactactacggcgccgcccatgtgttgccggtgcccggttcccaggcggcgatccagctgctcccgcgtttgcgccgcgccggcaaggtcggcgtgctgtcgccctgttatgccgaacacgccgaagcctggcgccgcagcggctacatcgtgcgggaaatgctggaacaggaagtggactttttcctcgacagcctggacgtgctggtggtggtcaacccgaacaaccccacgggtttgagcctgaccccggagcgcctgctggactggcatgcgcgcctggcgcagcgcggtggctggctggtggtcgacgaagccttcatggacaacactccccggctgagcctggcggcccaggccgatcaggtggggttgatcgtcctgcgttccttcggcaagttcttcggcctggccggtgtgcgcctgggcttcgtcctggccgagcgcaagctgctcaagctgctggccgagcaggtcggcccctgggccgtcagcggaccgacccgggtactgggccaggtgtgcctgcgcgacagccaaggccatgagcggcaacgagtgcgcagtgaagcggcgagcctgcgcctggcgcagttgctcgagcgccacggtctgaaaccccagggtggctgtgcgctgttccagtggctgatcaccgatcgcgccgagctgttgcatgagttcatggcgcgccggggcatcctgctgcggctgttcacccacaacagcagcctgcgttttggcctgccggccgacgaagccgattggtcgcgtctcgaacaggccttcgtcgcctacgccaaggaacatccatgaccaccctgatggtgcagggcaccacttccgacgccggtaaaagcaccctggtgacggcgctctgccgctggctgacgcgccagggtgtcagcgtcgtgcccttcaaaccgcagaacatggccctcaacagcgcggtgaccgccgacggtggcgagatcggccgggcccaggcagtacaggcccaggccgcgcacctggagccgcacaccgacatgaacccggtgctgctcaagcccaacagcgacaccggggcccaggtgatcattcacggccgtgcggtgaccaccatgaacgcggtggcctatcacgactacaaggccatcgccatgcaggcggtgctggcctctcatcaacgcctgagcgcggcctatccggtggtgatggtggaaggcgcgggctcgccggcggagatcaatctgcgggccggcgacatcgccaacatgggctttgccgaagcggtggactgcccggtggtgctgatcgccgacatcaaccgtggcggggttttcgcccatctggtgggcaccctggagctgttgtcgccgagcgagcaggcgcgggtcaaaggtttcatcatcaaccgtttccgcggcgatatcgccctgctgcaaccgggcctcgactggctcgaagcgcgtactggcaagccggtgatcggcgtgttgccctatgtgctggacctgcatctggaagccgaggacggtatcgaccagcgtcaggccgacaaggtcgagcaggtgctgaaagtacgggtgccggttttgccgcgcatcagcaatcacaccgacttcgacccgctgcgcctgcacccccaggtggacctgcaattcatcggtcccggccaggcgattccgtcggccgacctgatcatcctgcccggctcgaaaagcgtgcgcagcgacctggcgtacctgcgcgcccagggctgggacacggccatcgcccggcacctgcgctacggcggcaagctgctgggcatctgcggcggtttgcagatgctcggcgagcagctgcacgaccctttggggttggaaggcgcgccaggctccagcgcggggttggggttgttggcgttcgagacggtgctggaacaagagaaacagctgcgtaatgtgcgtggacgtctggcgctggaggaggctgaggtcagcggttatgagatccatgccggcgtcacgacggggccagcgctggagctggccgccgtgaccctggacgacggtcgctgcgacggcgcgcgcagcgacgacgggcagattctcggcacttacctgcacggtttgttcgaggcgccggcggcctgcagtgcgctgctgcgctgggcgggtttgcgcgaggtgcaggcggtcgactaccacgccctgcgcgagcgtgacatcgagcgcctggccgatctggtggagcggcacctggacaccgagcacctgcgccagctttgcgggctttagagcgtcggcgccggcattgccgcgccgctgtggctgtacctcaattcaagggtttccaagcatgttgcaactgatcctcggcggtgcccgctccggcaagagtcgcctggcggaaaagctcgccggcgcgagcggcctggccgtgacctatatcgccaccagccaggcgctggacggcgaaatgaatcagcgcatcgcccatcaccgcgaacggcgtccggcccaatgggcattgatcgaggagccgttggagttggcgcgggtgctgcgcgaagccgcgagcgccgagcgctgcctgctggtggattgcctgaccttgtggctgaccaacctgttgctgctggaggatgcccagcggctcgccagtgaacgcgaagcgctgctggagtgcctggcgtcgctgccgggagaaatcatttttgtcagcaacgagaccggaatgggtgtcgtgccgctgggcgaattgactcgccgttatgtcgatgaagccggttggttgcatcaagccctggccgagcgttgtcagcgggtagtgctgacggtggccggcctgcccctgactctgaaaggaactgcgttatgaatgacttctggtggctgcggccgtgcaaggcgctcgacactcaagccctggaggcggcgcagtcgcgtcagcagcaattgaccaagccggcgggttcgctggggcaactggagcgggtcgcggtacagctggccggcttgcaggggcgggtcaagcctggcctggagcagctgtggatcgcgattttcgccggtgaccacggggtggtggccgagggtgtttcggcttatccgcaggcagtcaccgggcagatgctgcacaacttcgtcagcggcggcgcggccatcagcgtgttggcgcggcagctgcgggcacgcctggaagtggtcgacctcggcacagtgacgcccggcttgaacctgcccggcgtgcggcatttgaacctgggggcgggcacccggaacttcgtcgaggggccggccatgacccaggcccagggcgagcaggccctgcaggccggacgtgacagtgtgctgcgggccgtcgagcagggcagcgaactgtttatcggcggcgagatgggtatcggcaacaccaccgcggccagcgccgtagcctgcgccttgctggacattccggtggcgcacctcgcggggccgggcaccggcctggatgcggcgggtgtcagccacaaggcgcgggtgatcgagggcgccttgagtctgcatgccgcccagcgtggcgatgccttgcagaccttgttcaacctcggcggtttcgagatcgccgcgctcgttggggcgtacctggcctgtgcccaggaaggcgtcgcggtgttggtcgatggtttcatttgcagcgtggcggcgctggtggcagtgcggctgaaccccgagtgccgcccgtggctgctgttcggtcaccgtggggccgagccggggcatcggcatatcctgcaaaccctcgaggccgagcctttgctggacctcggcctgcgcctgggcgagggcagcggcgcggcgctggcggtgccgttgctgcgcctggcctgcgacctgcacgggcagatggcgactttcgccgaggcggccgtggcggatcgtccggcatgaccttgcgcctggacctgctgcgccatggcgaaaccgaactcggtggcggcctgcgcggcagcctcgacgatgccttgaccgacgtcggttggcagcagatgcgtgctgctgtcgcaggcctggggccctgggatcggctggtgagttcgcccttgcaacgctgcgcacgttttgccgaggagctgggggcgcgcctggcgctgccggtgaccctggacccggatctgcaggagctgcatttcggtgcctgggaagggcagagtgcggcggcgctgatggcgaccgatgccgaggcgctggggtggttctgggccgatccctatgcctttaccccgccgcagggtgagccggtgctggcgttttccgcgcgggtgctgggggcggtcgaacgtctgcatcagcgttatgccggcgagcgggtgctgctggtcagccatggcggggtgatgcgcttgttgctggcccgggcccgaggtttgccgcgcgagcagttgctgaatgtcgaggtcgctcacggtgccttgttcgccctgactgtcgaggctggcctggtattgagcgaaggagtctgagcgtgttgccattctggatcgccctgcaatttctcagcagttttccggtgcgtttgccgggcatgccgtcgcccgaggaaatgggccggtcgttgctgttctatccgctgatcggcctgctgttcgggctgctgctgtgggggctgaaccagttgttgatgggcgcgccgctgttgctgcatggggcgttgttgctgacggtctgggtgctgctcagcggtgccttgcatctggatgggctggccgacagcgcggacgcctggctgggcggcttcggcgatcgcgagcgcacactgaagatcatgaaggacccgcgtagcgggccgatcgccgtggtcaccctggggctggtgttgctgctcaagttcgccgcgctggtagcgttgatcgagcagcaggccggtgttgccttgctgctggcgccgctgatcggtcgcggcgccttgctcgggctgttcctttgcacgccttatgtgcgccctggtggccttgggcaggcgctggcgaatcatctgccacgtctggccggaaagtgggtgttggcgctcgccgcgctggcctgtgtcgtgctcggtggttggggcgcggtgttggcgttgctgctggcgagcctggtgtttgctggcttgcgtcagctgatgctgcgtcgcctgggcggtaccaccggggacacggcgggcgccctgctggaactgctggaggtgacggtcctggtagggttggcgctgttctagaaaggcggagcgcgggttctattcgcgccctgaactatgcaaatttcttgcattcccttaatcgcgggtatatacacgcaccatgcttccttctcaatgtctgtgcaccaacctgcggcgcgccgcccgtggcgtcagcaggttctacgacggcgctctcgacggcttcgggatcaacgttgcccagtattccctgctgagcaacctgcagcgcctggaccaaccgagcatttccagcctggccgaggccatgggcctggaccgcagcaccctgggtcgtaacctgcgggtgctggaaggcgagggcctggtccggctgtccgaaggcgaggatcaacgcaatcgcatcgttcagctgaccgatgagggccagcagcgactgctggcggccttgccagcctgggaagcggcgcaacaacgcttgatcgaccgtctgggtgcagaaaaacgcgaaaccttgctggccttgctgaacgaactggcgtgaaggcctttcgttcgatgataagcgggtatatacccgcaaatggagaataaaatgacttcgatgtggcgtaccagcggttgggttcttctcgggagtgcgctgatcctggccttgtccctggggataagacatggcttcgggctgtttctgccgcccatgagcgcggaattcggctgggggcgcgaggtgtttgcctttgccattgccctgcagaacctcatctggggcctggcccagcccttcactggagccctggccgaccgcttcggtgcggcgaaggtggtactggtcggcggtgtgttatacgccgtgggcctgttgttcatgggggtggccgattcgccgctgtcgctgtcgttgagcgccggcttgctgatcggtatcgggctttcggggacctcgttttcagtgatcctcggcgtagtggggcgcgcgctgccggcggagaaacgcagcatgggcatgggagtcgccagtgcggccggttcgttcggtcagttcgccatgctgccgggcaccctgggcttgatcggctggctcggctggtcctcggcactgttggtgctggggttgctggtggcattgatcgtgccgctggtgagcatgctcaaggacaaaccgctgcccagcctgggccatgaacagagcctctccgaggccttgcgtgaggcctgctctcactccgggttctggctgctggcgttcggctttttcgtctgcggtttccaggtggtattcatcggcgtgcatttgccggcctacctggtggaccagcacttgccggctacggtgggcaccaccgtgctggcgctgatcggcctgttcaatatcttcggtacctacaccgccggctggctgggcgggcgcatgtccaagccgcgcttgttgaccggcctgtacctgttgcgcgcggttgtcatcggcctgttcctctggcgccggtgacgcagctcagcgcgtatctgttcggcatggccatgggctttctgtggctgtcgacggtgccgctgaccaatggcacggtggccaccttgttcggggtgcgcaacctgtccatgctgggcggcatcgtgtttctgtttcaccagttgggctcgttcctcggcggctggctcggcggggtggtctacgatcgaaccgggagttatgacttgatctggcaggtggcgattctcctcagtctgctggccgcggccctgaactggccggtgcgcgagcgtccggttgcccgtctgcaggcgagcgcggcatgagccggacaggtttgcgctgggtcggcctgatggttgttatcgccttgctggtgttggcctggtggggctggcaccagggtgggctggcgctgatgcagttgggcatgggcgtctgctaggaagcgcttgctagggcgtccgcggggcgagtagcttgaccctctgacggtactttcaaggagttgaatatgttggcgcgctggcttgctgttccagctgtattcatggtgttcgcaggttcgacctgggcgggcgaatgcccgtcgctgttgcagggctcgctgcccaagctgcgcgccaaggaatccatcgacctgtgccaacgctttgccggcaagccgctggtggtggtcaataccgcgagtttttgcggcttcgccccacagttcaaggggctcgaggcgttgtaccagcgttacaaggatcaggggctggagctggtaggcgtgccgtccaatgacttcaaacaggagtccaaggatggcgcggagacggccaaggtttgttatgcgaactacggcgtcaccttcaccatgaccgagccgcagcaggtccgaggcccggacgcggtgcacctgttcaaggtcctggccgagcagagcagtgcgccgaagtggaatttctacaagtatgtggtcgatcgccagggcaaggtgatcgccaatttctccagcctgaccaaaccggacagtcctgaattgatcgaggccgtggaacaggcactggcgtccaagccttgagatttatccgcggccaataaaaaagccccggcatccttggatgcgggggctttttcgttcaggccgtcaggctttagaagcggtaggttgcccccacgccgaagccgttcgcgctgttttcgtactcggcgctgtaagactggccgagctgctggttcctgttgttgaccttgactttctcttccttgaggtaggagtaagccacgtcgatggtcaggtcttcagttgggctccagccggcgccgaggctgaagatggttcggtcgccggtaggaatgcgtggcgagcggttggtgttgttggctggcgactggtcgaaggtcagaccggtgcgcagtacccactgcttgttcagctgataggaggtaccgatggcataggcccaggtgtcgtgccagttctgttcttccttgatggaactgagggcgcccggggccaggagaccgccggcgctggcggttacgccttcgttttgcacggtgatgtctttcagacggctccagcgggtccaggtcgcaccggcgtagagtttccaggcatcgttgaggtcctgggtcaccgacaggtcggccgactcaggggtggtgatgtccagcgaggcgtcgtagcgagcaccgcgcagcagggcacccggagtaccggcgcctgggctgacctcggtgtggccttccagcttgtacttgaccttcgagtgataagtcaggcccacgcgagtggtatcggttgcctggaccagcacaccgatgttgtagccatagccgatatcgtcacccttgatctggacattgccatcgttaggcgacagtggcgtggtcagcgcggattccagggtgccggagatacggttgatggtcgggccgaaaccgatcgacaccttgtcgttgaaggcatagctgacggttggctggaatgtgacgattttaacttcgcttttgctaccgaagttacggccctggaagccgctttcatagtcggtgatcaggccgaacggggcgtagacacccaggccgaaggcccactggtcatcgattggcttgacgtagtaggccattgggacggcggtgaacggcaccatatcgcctttgttggtccctctctggctaccgctggcgtcgttgatatcggtggacgcgtcaatggccgcgagaccgccagtgacttgctggcgtttcaggcgcgacataccggcagggttaccaaaaactgtgcttgcatcgtcggcagcagaggatcgaccggcgaaaccagtacccatgccgctgatgctttgttcgttcagggcaaagccacttgcgaaaagttgggtggatgccatggcaacggcaaggctaagactggttttgagtattacttttttcattattagaactcctggtgatcaccggagcgaaaattaccaacatttcctcctcaacgctataggctgtatggcctgagatagagcggttttgtaggacaatccgaccaaaattgcggttgtttgtgcgaacttgcaaaaagtccgatcagcaggcgacctgattcagtggcgcaacacaggtctgccaggcatcggcgaagtcccgcagacgtccttgtggctggaagatctgcttccagatacgagccatgccgaccaggtcatcggcctcggggagcggggtgttctgctcttctaccagcagccaggcgatggcggtggcgtaacgcaggttgacggtcaattccagatgcggcccgctgaggaatgcatgctggctggccaggccgcgaaccaggctggcgcgttccgggtccagggctagatagtggtcccagagtgcctggtggcggggttcggcgatgcggtagaggccgtggcctctgcggtcgtgcagggcggagccgagggcggattgactggcggcgatgcctagcagcaatgattctgcggtgcgactgtggttgcccagatagatcagggtcgggcggatcacgtagcggcacagttcgctggcggcaatacccataaagccctcgaagcgtgaagtggccggcgaggcctgatgggggagcttggcagcggtggatcggtcaggctcgccggaagcggatcatgccgcttgagttgaagtgtagtgtcatatcgttgctgtaaaggtctgtttttaaaatatttccggcttcctgttataaccgttatatcggatggtgctttagccgaaggcgggcaaatcgaaataacaggtaataaaaagccccgctattcaggcggggcttcgggttttcagcgctttggcgtctcaggcggtgagggcctgacgggtgcgctcgatcaccgcttgcagcggctcggcgctggaatactgatcggggtacaggcgttcgctgtgacgagcgataccgtgttcgttgaccagggtgaagctgaagcagcctttgcgagcggccatgatcaggcagttcattggagcaaaagcattggtgagggtgcgaatggcatcctgagtctggatttgagtagacatagttattgggtgttcctacaaatgacacggttaagaaccgtgcaacgttaaaacgttccagtaacgccgaccaccattggtcgaacgaagaacccgactggaacaaagcagccagttggaagcgctttatcaagtgcgcgctagggctggcaggtaggtacttaggagggcaggcaatcacagcaggggttaaggttctgggccccaggtgaagatcctgatcaatttgcaggttggttcggtcagagtaaaaagggtttcgcgacatcctttgcaatgtgttcaaaggcagtgtcggcaaaagctttacctggaaaccagcgaggtgatcgatcccgtgtagtcggtagaaacttctcttcagggaagctaaaccgggggacttgttcgaccagaattgactttcagcttggtactaacactgtggatgataacggattgatgtagctggtgcaagtgtgttaggcaaaatggttatgagtgtcacaggggacggggtcgtgaacgaggcaggccgggctttccaccgtagttgagcagaaagttgttactggagctttggtcttcgctgctgttctcccacgaacgggcgaaaaaggtgcaccgatataaccggatcaagggtacttgtgcacaatagttgcgcgggctgtcaccggcctgtcacctcacctgccgggccctccaatgcctgcgatgaaaatttaagtcaatgaaaaacatcggttttttttactggtgaaaaaatcgtcagtttgactgcgggccccgtcccatgcggctttcggagacttgtagggcggttgtccactgagttatccacagcttctgtggattgtcccaagcgcttgctctagcacgggcgtgccgagttttttcgactttacgcgtgtgaaaaaaggagtagagtggcgcgccttccgatctgccctacagtgctttatgaagtttcgctcagtgtcaccttctgttacctctgcctcttccagtgttaccgagcccaagcgtttttcgttacgtgtggccatgtggctgctcgacagcccgcgcctgggggataaccggaacgtcaagcactttgccgggcgtttgctcaagcagcctgcccgggaaggggtggtggccgcacagagtcgtcttggccagctgatgtgccgcgaatgcggcaacgcccgcgatcggcggattggtcatgacctgctgcgccaggcggcacgggctggcgatcgccgcgcccagctggagcttggccagatcgaagactgagctgtccaagcctcggtcccttggttaaccttcaagctttatttcactgtctggagtggctatggctatggacttgaccagcgtactgctcggtctggcaggcgcggcattgcccttggtggcgctcgcctggcaactgcaacgccgtctgagctcccgccaaaccgaactgtccctgctggaggaacgcctggccaccgcgttgctggcgcaggatggcttgaacgcccaactggatgcctgccgcgacgagatcagcgacctgggccaggccaatgccgtgaagcaggccgatctggcggcggtgcgccgggaggtcgagttgttgcagatcgagcgcgacaacgcccgtgatgccgcccacgcctggaaccttgaacgggccaacaaggaagccgagctgcggcgcctggacgctcaggccgcgtcattgaatgccgagttgcgcgagcagcaggaaagccaccagcaacgcctgagcgacctgcaaggctcgcgggacgagctgcgggcgcagttcgccgagctggcgggcaagatcttcgacgagcgtgagcagcgttttgccgagaacagccagcagcgtctcggacaattgctcgacccgctcaaggagcgcatccagtccttcgagaagcgggtcgaagagagctatcaggccgaagcgcgcgagcgtttttccctcggcaaggagctcgagcgcctgcaacagctgaacctgcgtttgagtgacgaggcgaccaacctgacccgtgcgctcaagggccagaaaacccagggcaactggggcgagctgattctcgagcgggtactggagcatgccggcctggagaagggccgtgagtaccagacccaggtcagcctcaaagggcccgacggcgagcgtttccagcccgacgtgctgatcatgctgcccggcgacaagcaggtggtggtggactccaaggtcagcctgaccgcctaccagcagtttgtcgcagcggacgatgaagtgatcggccaggcggcgctgaagcagcacgtactgtccttgcgcaatcacgtcaaaggcctggccggcaaggactacaagcgtctggaaggcttgcacagcctggatttcgtgttgctcttcgtacccatcgaggcggctttttccgccgccttgcaggccgagcccaacctgttccaggaagccttcgaccgcaatatcgtgatcgtcagcccgaccaccttgctggctaccctgcgagtgatcgacagcctgtggaagcaggagcggcagagccagaacgcccgggaaatcgccgaacgcgccggttggctgtacgacaagttcgtgttgttcattcaggatctggatgaagtcggcaatcgcctgcagcagctggacaaggcctacagtgccgcgcgcaacaagctgaccgaggggcgtggcaacctggtcagccgcagcgagcaactgcggttgctcggggcgcgtgccagcaagagcctgccggcggacctgctggagcgggcaatgaccgatgccgatggcgcgttgctcgaactgccggattgacccgggggcggaaggtcagagcggcagatgccggctcaacagcgcccgcaacgccgcgggcttcaccggcttggccaggtagtccagcccagcggcgtgcacctcggcgaccatctcggggcgcccgtcggcgctgatcaccacgcctggcaccgggtcacccaactgggtacgcagccaggccatgacctcggtgccggtttcgccatcgtccaggtgatagtccaccaatgccagttgcgggcgcacgccatcattgagcagcgccgcgcattcttcgcggttacgcgcggtccagacctggcagccccagcggctgagcaggctgttcatgccgatcaggatgctgtcttcgttatcgacacacagtacctgggcgccggacagcagatggccgttgagttcggccacctgcctcggtgcactgacggccgccttggccaaaggcacgctgacactgaagacgctgcccttacccggccaggagcgtacttgcaggccgtgaccgagcacgcgacacagcccgtcggcgatcgccaatccgaggcccaggcctttttcggcacgggtctggtggctgtcgaggcgtttgaattcttcgaagatcacttgctgcttatccagaggaatccccggtccacggtcccagacttccaggcacagctggttgccgcggcggcgcacgcccagcagcacaggccccttggcgtaacggaaggcattggtcaggaagttctgcagaacccggcgcagtagcttgatgtcgctgtcgaccctgagacggctgccgcgcaggcggaatttcaggccttgctcctgggccagcaccttgaattcggcccccagggtatcgaacagttcgttgagcacgaacggcttgcgctccggattgatcttgccgttttccaggcgggagatatccagcaggtcgctgatcaggtcttcggcagagcgcagggagctgtccaggtgctggaccaattgctgggcttcggcggacaaaccgtcgtcctggtgggagagggcggcggagaacagccgggcggcattcagcggttgcatcaggtcgtgactgaccgccgccaggaaacgagtcttggactggttggcggcctcggcggtgcccttggcctcggtcagcgcggcgttcagttgcgacagttcttgggttcgctcggcgacccgttgttccaagccttcgttggcttcggtgagggcctgttcggcctcgcggaacggggtgatgtcggtgaagctcatgacaaagccgccgccgggcatcgggttgccgatcaactcgatcacccggccattggggaacagccgttcggaggtgtgggcgcggccctgacgcatccagtgcaggcggcgggcgacatgcacttcggcctcgcccggcccgcacaggcctcgttcggcgttgtggcggatgatgtcggcgatcggccggccgacgctgatcagcccatccgggtagttgaagagttccaggtagcgacggttccaggccaccagcctgagggactggtcgaccacgctgatgccctggctgatgttctcgatcgcgccttgcagcaaggcccggttgaattgcagcacttccgaggcttcgtcggcgatgcgcaccacgtcttcgagctgcatctcccgcccttcgatggcggccttgaccaccgcgcgggtggacgatgcaccgagcacgccggccagcaggcgttcggtgtgggcgatccattcgccgtcggcgttctggttggggttgaagcctttgccctggcggtaggcaaagcggatgaagctctggcgggcccgttcttccccgacaaaacgcgcggcgagcttgagcaggtcgtcgatctgcaccgagagcatcgagcgggcgctggggcgaccgctgatttcctggccgatgaagcgcccggcctgccagtgctccgaaacccgggtacgcgacagtaccgagacccaggcgaacagggtgaaattgccggccagcgacagcaccacgccttgggtcaagggtgtgatcggcaggttcagcgggttgccgtgcagccaggccaggcccgggaagctgctcagcgaccagcccaggctgtgggcggcgatcggcaggaccagggtgtagaaccacaggaaagtgccggccgccaatccggcgaacacgccgcggcggttggcctgcttccagtacagcgcgccgagcatggccggggccagttgggtcaccgcggcaaaggcgatctggccgatggtcgccaggctcgcggtggagcccagcaggcggtagctgacataagccagcagcaggatgaccacgatgctgaccctgcgcaccgagagcatccagtggcggaacacttcgaagggccgttcggcactctgccggcgcagcagccagggcagcagcatgtcgttggagaccatggtcgacagggccacgctggcgacgatcaccatgccggtggcggccgacgcgccgccgatgaaggccagcacggccagggccggatgggcctgggccaggggcaggctgatgacgaacgaatccggcagcactgagctgggcagcagcatctgcccggccagggcgattggcaccacgaacagcgcggccagggccaggtaggcgggaaacacccacttggccaggcgcaggtcctggggttcgatgttctccaccacggtgacgtggaactgccgcggcaggcagatgatcgccatcatggcgacgccggtctgcaccaccatcgacggccagttgatggtttcttcccagtactgctccaggcgcggggcgagcatggcctggctgaacaggtcgtcgaaaccgtcgtacaggccataggtgacaaaggcgccgaccgcgagaaaggccagcagcttgaccagggattcgaaggcaatcgccagcaccatgccgcggtggtgctcggtggcgtcgaggttgcgggtaccgaagacgatggtgaacagcgccaggatcagcgacacgatcagcgccgtgtcctgggcgcgggtgcccatggtgtcggcccccgcgccgatcagcaggtccacgccaagcacgatgcccttgagctgcagggcaatataaggaagcacgccgaccaggcagatcagcgccaccaccaccgccagggtctgggacttgccgtagcgtgcggcgatgaagtcggcgatggaggtgatgttttcctgcttgctgatcatcaccatcttttgcaggacccagggcgcgagcaccagcagcaggatcggccccaggtagatcggcaagaacgaccagagttgctcggcggcctggccgacggcgccgaagaaggtccagctggtgcaatacaccgccagcgacaggctgtaaacccaggcgcgcactcgcggcggcaagggcgcgctgcgacggtcaccgtaaaaggcgatggcgaacatgatggccatataggccagggcgacgatggcgatcagcccgctggacagcgacatggaaactccgaacataaaggcgcgccgggcgcttcagcccggtcagacagtctcgcacgatgttcggggttcgtcagtgtcgaccaaggtattggcgcggccaggtgtcgcagggggaagagggctgtctgtcaggttttatcgcggaaggcgcgcgcctatggaaggtggctcggaatcggttggcgcgagagcggcctcaaggccgcagcgcgatgtcgatcagttcatgcagttcctgcacttcaagcggttgcgcggcgaacaggatgcggaacaccgttggcgccaccagcatgttcaacagccggtcgatgctgggcagggctgtttcgctgtgccggtgacggtcgaggatgatctgcaattgcctgctgagaatgctcacgcaatagccgggcgtgctgctgcattgcacgtcgcgcatcatgttgcgcccgggttcggagctcatttcgtcgaggtactgttcggcccaggcccgcaggtcgccgcgcaggctgccggtggcggccggttcgctgtccgggcgcatgcgttccagggcgacatccgccagcagtgccgacaggtcgccccagcgccggtagatggtcgagggcgtaacgccggcgcgggtggcgatttgcggcacggtcagggtcgagcgctcctgttcttcgaggagttccctgactgccgagtggatggattcctgtacccgggcactgcgcccgcccgggcgtaaaccttctttaatagccatggatcgaaccttaacacaaagaatttgctttaagcgcgaggcggtagcacactccgcaaaagcaaaaaattagctttaatggagcgtgcccatgtccagtagtgtcgactcttcacggtcaaaccgttccagactgttgtttctggcgatcaccttactcagttttctcgccgcttccagtgtgccgacgccgatgtatcacctgtatcaggaggcgctgcaattctcgtcggcgaccttgaccctgatcttcggtgtctacgccttgagcctgctggcggcgctgctcaccgtgggctcgctttcggattatctgggacgcaagccggtgatcttcgtggcgctgctgctggacatactggcgatgctgctgttcatccaggccgacagcgtggcctggctgattgctgcccgggtgatgcagggcttcgccaccggcatggccaccagtgtgctgggggcggcgctgctggataccgaccgccaacaggggcctctggtcaacagcgtggcgcccttgctgggcatggcgtgcggggcgatgggcagcggcttgctggtggaatatgcgccgttgccgctgcaactggcctactggttgctgctggtgctgtttgtcgcccaggcgctgtacgtctggcgcctgccggagacggtcactgcccagcccggtgtctgggcttccctgcggccctcgctgcatgtaccgccccaggcgcggcgggcgctgtggttggcgttaccggtggatgtggcggtgtgggccgtgggcgggttctttctgtcattggcgccatcgctggtgcgcaccgcgacaggctcgacctcgaacctgatcggcggtggcctggtggcggtgctgaccctgagcggtgccctgatgattgtttccctgcgccatcgtccggccgacaaggttctgcggttgggcgcgagcctgctggccgtcggcatcagcctgatcctcatcgccgtgcacaccgccagcctgccgctgttcttcctcggcaccctggtcacgggcggaggttttggctccgggttcctcggcgctctgcgcagtgtgatgccgctggccttgccccatgagcgggcggggttgatgtcggcgttttatgtcctgagttatctggcgttctgtctgccgtccctgctggcgggaaacctgacgcgcagtttcggcctgatcgctaccaccgacggttatggcgcagtgttgatcctgttgtccctgggcgctttgctggggttgctgcgccagcgcaccgccaaggcctgcgtcgcgcaagagagttgagcgcgacgcggatgccggtggttgaaacgcaggcagtgtctagctcttatatttacaaaatagataacagatagagaaattacccgttatatagatattcgatccggttctaccatgggctccacctcatcggaggacaggagatcacaccatgacatgccccaataccctcagaaccggacggcccttgagccagctgcagcatcctcgcgaagccatccgccatttcacccccaactggttcgccgccaccatgggcaccggcgtgctggccctggcgctggcccagttgccgctgcggatcccgggcctgcacctgttggccgaggggctgtggctgttcaccatcgggctgttcgtggtgttcagcgcggcctatgcggcacgctggataatgttcttcgacgaggcccggcggattttcgggcattccacggtctcgatgttcttcggcaccatccccatgggcctggccaccatcatcaacggtttcctgctgttcggcgtaccacgctggggcgacggtgtggtgcagctggccgagctgctgtggtggctggatgtggcgctgtcgctggcttgcggggtgttgattccctacatgatgttcacccgccaggagcaccgtatcgaccagatgaccgcggtctggctgttgccggtggtcgcggccgaagtcgctgccgccagtggcgggctgctggcgccacatctggtagacgcgcattcgcaactggtgatgctggtgaccagctatgtgctctgggccttctcgctgccggtggctttcagcatcctgaccattctcctgctgcgcatggccttgcataagctgcctcacgaaagcatggctgcctcgagctggctggccctggggccgatcggcacgggagccctgggcatgttgctgctgggcgcggacgctccagcgatcttcgccgccaacggcatggccgcaatgggcgaaatcgccgagggcctgggcctggtggccggtatcaccctgtggggtttcggcctgtggtggatgctggtagcgctgctgatcaccctgcgttacctgcgcgacggcattccgttcaacctcggctggtgggggttcaccttcccgctgggggtctatgccctgaccaccttgaaactggccgctaccctgaacctgacgtttttcgcggtgttcggcagcctgttggtcctggcgctggcactgatgtggctgttggtgggcaagcgcacgctgcagggcgcttatcgtggcgagttgttcgtttcgccttgcatcgcaggattagcgaaataatccgcgaactttaggtaaggttgtggcctggaccgaagatcgataatccaataacagcatccaagccactcagggacatggaagatgagtcacccctcacagttcaccttgcttcgtacgcggcgtttcctgccgttcttcattacccagtccctcggtgcgttcaacgacaacatcttcaagcagtcgctgatcctcgccattctctacaagctggccatcgagggagaccgttcgatctgggtcaacctctgcgccttgctgtttatcctgccgttcttcctgttctcggcgctggccgggcaattcggcgagaagttcgccaaggacgcgttgatccgcctgatcaagctcggcgagattgtgatcatggccgtggggcggtgggatttgtcttcgatcacctgtcgctgatgctgctggcgctgttcgccatgggcacccactcggcgctgttcggcccggtgaaatattcgatcctgccccaggcgctacgggaggaagagctggtggggggcaacggtctggtggaaatgggcactttcctggcgattcttgccgggaccattggtgccgggatcatgatgtcctccgcccattacgcaccgattgtctcgacggcgatcattgccgtcgccgtgctcggttacctcgccagccggggcatcccccgggccgcggcggccaccccggacatgcgtctgaactggaatatcttcagccagtcctgggccaccctgcgcctgggcctggggcagacgccggctgtgtcgcgctcgatcgtcggcaactcgtggttctggtttgtcggggcgatctacctgacgcagattccggcctatgccaaggagtggatgcacggcgacgagacagtggtcacgctgatcctcacggtgttctcggtgggcatcgccgccggctccatgctgtgcgagaagctttcgggacgtaaggtcgagatcggcctggtgccttttggctcgttcggcctgacggtgttcggcctgctgctgtggtggcattccggcgggattgcgccaagcgaggcggggtacagctggctcgaggtcctcggttttggccacgcctggtgggtgctgatcgatattctcggcctgggcatcttcggtggtttctacatcgtgccgctgtatgcactgattcagtcgcggaccccggagaacgagcgggcgcgggtgattgccgcgaacaacattctcaacgcgctgttcatggtggtgtcggcgatcgtctcgatcgtcttgctgagcctggccaagctgtcgatcccgcagttgttcctggtggtgtcgctgctgaacatcgcggtcaacgcctacatcttcaagatcgtccccgagttcagcatgcgtttcatgatctggctgctcagccattccatgtatcgggtcgagcaccgcaacctggaggcgatcccggacgaaggcgcggcgttgctggtgtgcaatcacgtgtccttcgtcgatgccttgctgatcggcggcgcggtgcggcggccgattcgtttcgtgatgtattacaagatctacaacctgccgctgctcaacttcatcttccgcaccgccgggaccattccgattgccgggcgcaacgaggacatccagatctacgaaagggcgttcacccagattgcccgctacctcaaggatggcgagctggtgtgcatcttcccggaaggcaagctgactgccgatggcgagatcaatgaattcaagggtgggctgacgcggattctcgaagagacaccggtaccggtgattccgctggcattgcgggggctgtggggcagctttttcagccgcgatccgagcaagggactgttccgccgcctgtggtcgcgagtgaccctggtggcgggttcggccgtgaccgccgacagtgccgaaccggcccgtttgcaaacccttgtgggcgagctgcgcggtagcctgcgctgatacctgtagccgctgccgcaggccgcgctcgcccacaacgtgggcgcaggattttaagatcgctgaaggccttcggccttatcgcagcctgcggcagaggctacaggggggatcaggccgcgctgaccttcaagccgatcagcccggtaatgatcagcgccacgctggccaggcggaacagcgccatggactcaccgaacagaatgattccggcgatcaccgtgccgaccgcgccgaccccggtccagatggcataggcggtgcccagcggcagttccttcatggccagccccaggagaccgaggctgaccgccatggcggcgatggtcagggcggtagggagagggcgactgaaaccgtcggtgtacttgaggccgacggcccagcccacttcaaacaggccggcgaaaaacagaatgatccaggacatgatgacctccatcgattgacggggtcgtccccagattaatgactcaatcgagccgcggggtcgtccccgcgttgcgcagtatagtgcccatcattaatccggggatcaaggtttctcctcagtcgctcgcctgctgggcagccagtgtgcggtcgtccttttcgctcatgcggcggaaccaggtggaaagcagcgccccggaaatgttgtgccagacgctgaacagtgcgctcggcaccgccgccaggggcgagaagtgcgcgctggccagggcggcgccgaggccggagttctgcatgccgacttccagggccagggatttgcgttgcgccaacggcagcttgaacaggcggccggtgaagtaacccagcaggtaaccgaagctgttatgcagcattaccacggccatgatcagcaggccggactcggcgattttcgcctggctggcggccaccaccgcggtgacgatgatcacgatgctgaccaccgataccagtggcaacacttccaccgcatgccgcacccggtcgccgagcacacgctgggcaatcaccccgagcacgatcggcagcagcaccacctgcaggatcgaccagaacaactccatgaacgagaccggcagccaggccgaggccagcagccagatcagggccggggtcagcagtggtgccagcagggtggtgacggcggcgatcgccactgacagcgccagatcgccgcgggccagccaggtcatgacgttggacgaggtaccgctcgggcagcagccgaccaggatcacgccgacggcgatttccggcggcaggtggaatacctggcacagcaaccaggccatgcccggcatgatcacgaagtgcgcgaccacgcccagggccacgcgccacggatggcgggcgacttcggcgaagtcttcgagcttcagggtcaggcccatgccgaacatcaccaggcccagcagcggcacgatggcgcccttgaggcccatgaaccagtctggctgcaagaacgccaccaccgcgaaaatcagtacccagtaggcaaaggtattgccgacaaaacgacttaatgctgccagtgcacgcatggcctgttccttcttatatgaaaacgccaccgaaagcggtggcgtctgtggtgctcctgcaggagcgagcgagttggcgacaaggccggatgcggcccgtcgccagcaagcaggctgctacaaggtcagatgccttgtggaatctcttcgccacccagggcttcgaacagcgccgggaggaaatcgccgaaggtcagcatcatcagggtgaagctggcatccagctggccgagggcttcgtcgccgccgtcctgttccgcctgatcctgcagcaggtcctcgaacttcaggcgcttgaccgtcatcttgtcatcgagcatgaaggacagtttgtcctgccaggccagggacaattgggtgaccaccttgccggtgctcaggtgcagctggatttcttcgctggtcaggtcctggcgcttgcaacggacgataccgccgtcttcatgggtgtcgcgcagctcgcactcgtcgagcacgaagaagtcgtcggcggcttgttgggttttcacccagtcggtcatgatcgcggtgggcgcggtcttcacggtcagcggacgcaccggcagggtgccgagcacttcgcgcagggtggagagcaggtcttcggcgcgtttcgggctggccgagttgaccaggatcaggccctgtttcggcgcgatggcggcgaaagtcgaggagcggcggataaaggcacggggcaggaatgcctggatgatttcatccttgatctgatcgcgttcctttttataaaccttgcgcatttgctcggcttcgatctcttcgaccttttccttgaccgcgtcgcgcaccacgctgccaggcagaatacgttcttccttgcgcgcggcgaccagcaggaagtcctggctgacgtgcaccagcggcgcatcttcgcccttgccgaacggcgcgacgaaaccgtaagtggtcaactcctggcttgcacatggacgcgccagtttggtggccagtgcggtttccagcgcctcagcatcaaagggcagatcttgggtcaggcgatagataagcaggttcttgaaccacatggggtgaatctctcctttatacaaaggggggcattattctccgcgcagctccataggccaaccctccgctaagcctttggaaggcctgaaaaaattattttaaaaagtgcttgccagagtaggggacgctccgtagaatgcgcgccacaccgaacgtgaagggtgattagctcagccgggagagcatctgccttacaagcagagggtcggcggttcgatcccgtcatcacccaccattcgctttcagtgttacgcgcagcggtagttcagtcggttagaataccggcctgtcacgccgggggtcgcgggttcgagtcccgtccgctgcgccatattcgatgatctggaacactgaacgccaggtcatcacagaaagcccgctaacgcgggcttttttgtgcctgagttccgcgcgaggcgcccgagacatcgaaattcagctttttttgataattttattatttaaatcagcacgttatgaatttctgtgtaataatgcgccccgcaacgaaggtaaagggtgattagctcagctgggagagcatctgccttacaagcagagggtcggcggttcgatcccgtcatcacccaccacttgctttcaacgctacgcgcagcggtagttcagtcggttagaataccggcctgtcacgccgggggtcgcgggttcgagtcccgtccgctgcgccatattcgatgagctggaacactgaacgccagctcatcacagaaagcccgctcacgcgggctttttgctgtctggcgtatgtaaatgctccccaaaaaagcggcccgcgggccgcttttttcgtttctggatcactgctcggcgttgcggctgtgccggtagtcgctgaccgcttcgtacaccgccttgcgcaggcggttgatgccgccgatggggcggtgcgcttccagcccgaaccaggggttgaaggacaggttgtcgcattgcaggttctgctgcggggtatcgaagtcctgggcgggaattttgatccgcgcgacggtttcgaagggcgcatcgctttctcgccattcgatgctggtgtcttcgatgggcatgtagtggcttgggtcctggcgttgcacctgcaacacgaagcaggccggcacacgatcggtcgacagctgctggttcagggcgttgcgcagaaagttgggcatggcctggttctgtgcgggcaggttgtacgtcgggcagctgtccggatccggtacgacgcggaacttggcgttggcgctgccgaacttgtagggcgaaaccgaaaaatagcgggtttgcgtcgggctggccgggggtggtgacagggtggccagggcgatgaatagatgacgaacctgccaggtgcgtgggtcccaaccggggaaaaaggctccaaccttttttccgtccgcctgcgcggcgacattctgccgatattcggcgacgtcgctgacgaagaagttcggatggttgaacatcacgaaatcctgctcgccacggccctgctgttccttcaatagttgggtgccgggcacattcaacaacttgattgccattccgcgcgcgtcacgaatgctgtcgaactgtggataagcattgccgttggacagccgcaccatggcttgccaggtcttgccgggttcggcgaacacgccctggcgcaacggcggcgccagtttctcgagcacctggacctcggcctttacgcagccgtgggccttggcgtgggcgtcgcgcaggtaacgggtgttatcccggtgctgatcgacgatgcgcacggcggtctggatgatgtcctgggtcatggcggcttccccgggcggaacctgttcttcggtcgagaccggcccctggtagcgccagatggaccaggcgctgttcagcgcccagccgagcagggcgatcagcgccagcagcaaaagtgtcttgagcagcagcgcaccgatgcgcagccataaggtgatcagcatgaaagcgtcctttcgatgagggccagggtcatggcagttgcgcctccagcggcccgcccagtactttcaggtattccagcagggcccagcgttcctcgggttgcagcaggcggccgatcaccccgtcgccacgcttgcccgaacggaattcatggccgctgttgtgattgccgctgatcctggtatcgaacaggaagccgttcttgaacggctcggtacgatagcccagatgcttcggatcgtattcgaaggtgcctttatagaaggtgctggcgcgttcgtcctgaggcgaaagcaactgatacaggctgggcaccgaaccgttatgcaggaagggcggggtagcccataccccggccagcggccgggccttgtaggtgcgcagttcgcggacgccgatcggcaagccgtagccgtcgagtcgcgggcgttccgccggggtcacctgggcgtcccggtaggcgcgctcctcaacgaaggcagtgacataggccaggcccttggccgctgacagctggcgcatgtccagcggctcagtgggcgtggggtgcaactggacattcgattgcgccagctcggcggcgtcccattgcagcgcgctcaggtcgtaacgctgatcggcaatattgttggccgtattcgggtcggtgccgatcaccgcgactggcagcatcttcagttgttgtaccgggcgcccgttgacctcggtgaccggcgggacatggcagcctgcacagttttccgcgaacaacgctcgccccttggccgccaggggcttgtcgatgctgccgaacagttcttctggccaggtcggcggtttcagtcgttgcagggtttcttcgatgcgattgaggtcgcgtacccgaacgctcgacgcgtagcgggcgtcgcccttgagcggctggccttgggcatcgaagaagttcagggtggcgccgacgcccagcgcctcgccgatattgcgggccatgggttgctgggccgagccgttccactgcacccagtcgaaggtccagatgtcccatagctgcggatagtccaccggtgcgttggccactcgatagttgtcgggggaaatggcgtcgccgaagctggcattggcgatccggccaaaggcatcggtacgcccggggccttcttcggtgggatagaggccgcggtgagtgtcgttccaggcgacgcgcaggaaggtgtccagcgacgccttgaagtccttgcgcagtcgttcatgctcggcgtcgtagtcctggcccagcacgttgcgggcgaagcgttcgaacttccacgggttgtaataggtcgacgccaggctggcgaccagggcctggccgaagctgccaccgcgcagggtgggcacgctggagggcaatacatgttgcgccgaaccgccgtcgacccgcagggcctgatggttgtagcgcagctcgccggtgtggcaggcggcacaggtgatgtccaggtactgttgcgggctgccagggttctgatggcgggtgaagccgaccggcaggttcgccgggttatcggtgctggcctgctgcgccggatccaccaggaagccgaagcgggccaggtactgcggcgcggcgaagcgttgcgtggagaagggcagttccagggcggcgaaccactcatagcgcaggcctttcacctgagtgccctggggcgtgaagtaataggtctggcggtcggcggcgctccattgatcctgatagtgcacctgccgggcgggcacatagtcgggcaatttcggattggccacgtaatacaggaccacggccagggcaacgccgatcagggcgaggatcaagagcaaaacacgggataagaggcgcaagataaacatccttgtcgagttgtggctctcttatgcctcaagggcaaactgccgggcaagtggccattacgtgcgctgtcattactttgcggtcgaggtgttctttctcgtgctcgttgtaatggctggcgaaatgcttttaaacacgtgaacttatcgggctaatccggctctcatgccggtagccattggtcgtggccgcctgataagctcgcggctttactcgattgccctttaggcgcatgaacaaggaaatagcatgaaacagcatcggttagcggcggcggtagccctggttagcctggtactcgcgggttgtgactcgcagaccagcgtggagctgaaaaccccggcgcagaaagcttcctatggtatcggcctgaacatgggcaaaagccttgcccaggaaggtatggatgacctggattccaaagcggtagcccagggcatcgaagatgccatcggcaagaaagaacagaagctgaaagacgacgaactggtcgaagccttcgccgcgctgcaaaagcgtgctgaagagcgcatggccaagatcagcgaagagtcggcagcagccggcaagaaattcctcgaagaaaacggcaagaaggctggcgtgaccactaccgcctccggcctgcagtacgaagtgctgaaaaaagccgatggcgcccagcctaagccgaccgacgtggtgaccgttcactacaccggtaccctgaccaacggcactgtgttcgacagctcggtcgagcgcggcagcccgatcgatctgccggtcagcggcgtgattccgggttgggtcgaaggcctgcagctgatgcacgtcggcgaaaagtacaaactgtacatcccgagcgatctggcctacggcgcacagagcccaagcccggccattccggccaactcggttctggtgttcgagctggaactgctgggtatcaaggatccagcgaaacaagacgacgccaagtaatcttcgtctggttcaatgacaacgccccgtccttacggggcgttgtcgtatctggtcgttggtccgggaaaaaatgcgaacccacggcataaggcatagtcttaacagcacgtgttgcggctagccgcatgacgctgccaagtcaatgaaattatgggtttttttatgtgagtaaaaaacgcccgatctgagccgagcccttgtaaaacggggctttcagctgtgaaaagcggctctgttcacaaggttatccacaatttgtgtggataacatttcagtgggagtgacgatgaaagcaccctggaattttgcccgcttcctgcccctggccggccgcttgctcagccgtggccgactgccgaccctgttgttcgccgtggccagcaaaggcgccttgcaaggcggccgtcttggcaagctcaaggacgatctgcgcctgctgcaggccctgtgcctggcttactggcgtggcgagtaccgcgccatcagccccaaggcgctgctgtcggtggtcgcgggcctgatgtacttcctcagcccgctggatgccatcccggacttcctgccgatgttcggcatgctcgacgatatcgccgttctggcctggatcatgaaaactctggacggcgaactcagcgcctttcgcgcctggcgcaatcgccagcaaccggagaagctggcggtggtggagcgtttgcctgacaccccggaacagctgcaattggaaggtccgaagaaaaactgaggtgaattcggatccatacaacgatgcccccgcgaccttagtgactgttaggattacacttcataaggaaaagtccgactcgttatgtgtcgtcctacggggtagtaatggatattcagataattgcacgcgatggcgagcccgaatatgcggttctgccatgggctcagtatcaggctttgctaaaagccgcaggtatcaccgaacaatctccgcgagaagccagggggcctgtcgcgaccacagccgaccagccgcttccaggtctggatcaacttcgcagtttgcgtgaagccaagggcatcgccattgaggcgcttgcccgtacggtaggtatcagtccgtcatatctggccatgattgaaagcggtgagcgtcaacccgacgccgctatacgccgtagcctggcctgggaattgacggttccgggttggagggatgaatcgtgagcgtaaggatcagtcgtcaacattgggatggcctgttgggggaactcgaccaggcccgtcggcaacgccatcttttgacctatcgcgctctgcttgagcgcttgcagctacccagccccgccatgcagaccctgacggcggcccttgagcatctggccgcgctggacgcgcgtgcggagcagccgttgcgcagttcgctggtgatcagccagggggcgagtcgattgccgcgcaccggtttcttcgagtgtgcggagcgcctcgggcgtttttccgggccttccgatggggtcgcggccgcgtcgtggcatgcctcggaagtggttcgtgtgttcgagtacgaataccccgagtcggtggaggcctgagtgttctggcgcctcaaggcgcgagccggctactggctggctcgccggtggtttcattggccctggtttgtgcgtcaaccccggggctggcactggctggaggggcaattggcgcgcatggcgaacctgggggacgtaggcgcacagagcttttatggccatatcctgacctttcgtggccaggggctgggggctcgcgaagaaggcatacgcctgttgcgtcttgccggcttggccggggacgccaaggcggcctatcagatgggcgtcatcagcctggccggttcgcccagcaaggccgcggatgcggcgcaagccgcccgttggtggaccctggcggcgaaagccgggcatcccctggccgaggtcaagctggcgcagctgaatcagtcgagtacgctggacccgcaagccggtccgcgtcagccgtaaagccgtctgccatctggcggctgtcgatcacatggatgctgtagcccggcacgttcttggcgtggtgcttggcttgcgaggccagctcggccaactggctggcatcgagttgtccacaggcctgtggatacaggtgcaccacgccaatggacagtgacagcaaggcgaactcctggcgaatgccctggcggttgggggcgatgaagcagccggcttccaggtgttcgctgcgataaaaacgccggcactggctatggaagtcgtccagcagctggttcaggcgtttttgccagtcctcggggcccaataccaggagaaagtcgtcgccgccgatatggccgacgaaatcgcggctggggtccacccggtcattcaggcactgcgccaggcacaacagcacttcatcgccacggccgtagccatagatatcgttgaagggcttgaagctgtcgatgtccacgtaacagatcagcgattcccgtccttgttgcagcaggtgggtcaggcactgctggatcggcacgttgccaggcagcagggtcaacgggttggcataacgcgcctgctggatcttcagctcggtaatcagcttgagcacatcgatcactcgtcccaggcccaggtagctaccgttgagggtgatgatgaaatcctcttcgatccgttgccgggcacggctggtgatcaggcggctgacctgttgcagcgactggctgagttccaccgccaggaagtcatcgttcatcaggcggctgatgggcttgcgggcaaacaggtcggtggcaaagggcttgagcagggcatcggacaatgaatggcggtgcacgatgccgcagggctggccctgtccgtcgagcaccgccagcgagttgaggttggcctggcgacggaaggcttccagcaccgtggccgttggtatgtcgcgtgctaccgccggttgttcgttgagcagggcactgaggtcgcagccttcgtcgttgagcgtcgcgggagtgctttcgcgcttgggcagcaggttgcggccatcgcggggcggatgttcctgggggcggcagagcaggtaaccctgtagcaggtccacgcccatttccgtgagcacctccagctcttccgccacttcgatgccctcggcgatcacctgggcccgggaggctttggcaatttgcaggatcgagccgacgaactcgcgcttgagggcatcctgatgaatgccgtcgataaagtgccggtcgatcttcacgtagtccgggcgcagctcggaccacaggcgcaggctcgagtaaccggcgccgaggtcgtccagggcgatcgagaaacccatatcccgataatgatgcagcgcattgtgcagcagctggaagtcatcgattggcgtctgctcggtgagttcgatcaccacctggctcggcggaataccgaagtcttgcagcagttgcagggtgcgcccgggctggtgggcagcctccagcagcgattccggagagacgttgaggaacagtttgccgggcaactgctgctcgctgaatcccttgcaggcgctctggcggcaggcgatttccagctcgttgaggcgtccgacctggcgggccacggcaaacagggcgacaggggagtgcagcgggctgttggacgggccacgggtcaaggcttcatagccgagaatgcgtcgttcggagagacagatgatcggctggaacagactgtgcaaaccgctttgagccaggattgagctcaaggcactcagctgttcggtcgtggtcatggcgatctctgtcgataaaaaaaggaccgggcgcgcccttgattcaagagcagcgcccggtcctttatttcacgacagaatgatgactgtttgatgacgctccgaggagcgtcagcattaaattgccaccatctcagtgcttggcgaccgcggtgttgagcttcaggtaatcgaggaggattcgcccggtttcgctgaggtaagcgtcgtcttccggcttggtcttgtccggatcggcggccgcgatggcgtcctcgtcttctttcttcagctccttgagcggctcttcacccttggccttgcggcggatgttttccagcgtcagttgcttggcctcgatgtcggcgtgttgtgcccgacgttcggcttcgttgaggctgacggttttttccgccatcagcttcttggccagggccagcttgtcgcggatgaagacgaactcggcgtccttggccgagcgcacgtcatgctcggatttcagctgcgcgaggaacggcttgaacggatccaccgccggcttgatggccgggcgaatggtgtcccatggcatggcttcgggcagggcgctttcgccgatttccttggtgtcgatgatcgacgggtaatcgatgtccggcagcacgccctgatgctgggtgctctgcccggaaacccggtagaacttggccagggtcagtttcagctcgccgtggttgagcggctggatggtctgcacggtgcctttgccgaaggtctggccaccgatgatcagggcacggtgatagtcctgcatcgcaccggcgaaaatctccgaggccgaggccgagagacggttgaccagcagcgccatcggccctttgtagaaggcgccagggttttcatcttcgagcacgtcgacccggccgtcggcgttacgcaccagcacggtagggcccttgtcgataaacaggctggtcagctcggtggcttcctgcagggaaccgccgccgttgttgcgcaggtcgatgaccacgccgtcgaccttgtctttctgcaactcggtcagcagtttcttcacgtcacgggtggtgctcttgtagtccggatcgccggcacggaaggccttgaagtccaggtagaaggccgggatctcgatcaccccgagcttgtagtccttgccgtcctgcttgaggttgaggatcgacttcttcgccgcctgctcttccagcttcaccgcttcgcgggtgatggagacgatcttgctggtctggtcgttcggcgcgttgctcgccgggatgatttccaggcgcaccaccgagcctttcggaccacggatcagcttgaccacttcgtccaggcgccagccgaccacgtcgaccatttccttgtcgccctgggccacgccgatgatcttgtccgccggggccacctgcttggtcttgtccgccgggccggccggcaccaggcgcacgaccttgacctggtcgttgtcgctctgcaacacggcgccgatgccttccagcgacaggctcatgttgatgtcgaagttctccgcgttatccggcgacagatagttggtgtgcgggtcgtaggacatggcgaaggtgttgatgtacgcctggaagatatcttcggcgcgggtctggtccaggcgggcgagctgattcttgtagcgcttggtcagcgtttcctgaatctgcttgggttccttgccagcgatcttcatgcgcaggacttcgtccttgacgcgcttgcgccacaggtcgtcgagttccgcggtggtcttgagccaaggcgcgtccttgcgatcgatcagcaaggactccttggtggtgaagtcgaatttgtcgacgcctttgcccagctcggccagggcaaagtccaggcgcgccttgacgcggtccaggtagcgtttgtagatgatgaagccggcgttcaggtcaccgcttttcaggaagtcgtcgaactgggttttccacttgtcgaattccgcgatgtcgctggccatgaagtagctgcgcgacgggtccagcagcttcaggtagctgtcatagatgatcgccgagcgcgcgtcgtccagcggtggcttgctgtaatgatgacgcttgagcagctcgacgacattgaggctggcaattacctcgtcgcgatccggctgaagtttgtcccagctattggctgcgaacgtattggtcgacatcggcagcagaccgagaccaatgaaaagagcgagggcggtgctggggaacaaatgcttcatgctgattcgacgcgggggcaattgataacgcatattaggccgtctttgaagtcgccggttccacaagggccggtcgcataatgcaaaaagcccggtgctacagctccgggctcagtccagactcactatggaggcactgtgaaagcattgcaaggcgttgaaggtcatgtggagtgggttgaagagcccagtccgacgtgcgacgtaggacaagtgcgcatccgcgtggcggccgcgggactgaaccgggccgacctgttgcaacgggccgggctctatccgccgccaccgggcgccagcaaggtgctgggccttgagtgctcaggcgtgatcagcgaggtcggcccgggctctgcgtggcaggtcggcgatcgggtctgtgcactgctggccgggggcggcatggccgaggaagtggtggtcgatgcccgtcatgtcctgccggtgccggaagggctgtccctggcgcaagcagcggcgctgcccgaggtgtacagcaccgcctggctgaacctgttccagctggcggccctcaagccgggggaaaaggtgttgctgcacgccggcgccagtggcgtcggttcggccgcgatccagttgtgcaaggcattcggcaacccatgctgggtcagcgtcggttccgccgatcgcctggcctactgtgaagcgctgggcgcccagggcggcgtggtgcgcactgatggcctggaaggcctgcgggatttcgggccgttcgatgtgatcctggatccggtcggcgccaactatgccgcgcacaacgtcaagctgctggccctggacgggcgctgggtgctgatcggcttgatgggcgggcgcgaggcccagttggacctggcgcagatcctcggcaagcgcatccagttgctgggttcgaccctgcgcagccgcgacgagcagttcaaggccgatctgttcagcgacctcagccagcatgtctggccactgttcgccgaagggcgcctgagtccgcagctggccatgaccttcccgatcaaggacgccgaagcggcctttgccgagctggcgaccaaccaggtgtcgggcaagctggtgctgctgatcgacgaaaccttggcctgatcctgtaaccgctgccgcaggctgcgataagcccgaagggcttcagcgatcttcagatcttgcgcccacgttgtgggcgatcgcagcctgcggcagtggctacagtggcgcttatttccactgatgaatcggccagccggccttttccgcgtgttcgcgcagcaccgggtccgggttgaccacatgcgggtagtcgaccttcagcagcaacggcaggtcgttgcgcgagtcggaatagaagctcgcgccttcgaggttttcttcttcggcatccagccattccagcaggcgggtgaccttgccttcgcggtaggtcagggtgcccagggtattgccgctgtagaccccgtgcagcacctccagctcgatccccaggacttcatcgatgcccaggcgttcggcgatgggctggaccaggtgagtgcccgaggccgagatcaccaggatccggtcgccggccttgcggtgggcggcgatggccttgcaggcgtcgctgaaaatgatcggttcgatcacgtcctcgacccagggaccgaccaggtgcccgacctcttccggggtgcggccggccatcggctccaggctgaaggccatgaactcttccatggccaacttgccgtggctgtaggcatccatcagctcgttgttgcggcgcatgaaagactcgctgtcgacccagcccaggcgccccatctgttcgctccagagggtggcgcagtcgccgtggatcagggtctcgtccagatcaaaaattgccagggccattagtaccgctctctcttaatcgtctgcgtcaaagtcatcaggctacctcacagagggccgtgggatcgatggaaagtgccaggcgttggccgtcggggtgcagatcgtccggcgagcggttcaacacatccaccaccagctccacgccacgggcctcgacccggtagcggatcacattgcccagcaggctatggctgcggatctgcgcgtcgggctcgccgtccttgcgcagttcgatggcttcgggacgaatcgcgatacgcccggtgatcggtcgctgcagcagcctgctggcactttctgcatccagcaggttgtagttgccgatgaagccagcggcgaacacatccaccggtgcggtgtagagcgtctcggcgtcgccgctctggacgatcttgccctggttcatcaggaaaatgcggtccgacatggtcagggcttcttcctggtcgtgagtgacgaaaatcgtggtcagccccagttcgcgctggatctgccggatctgttcgcgcaggtgcttgcggatccgtgcgtccagcgccgacagcggctcgtccagcagcaacaggcgcgggcgggtcaccagcgagcgggccagggccacgcgttggcactggcccccggacagttgatggggataacggctggcgaagtcgtgcagttccaccaggcgcaggacttcgagcacgcgctggtggctctcgtcggcgttgaccttctgcatgcgcaggccgaaggccacgttctgctccacggtcatgttggggaacagcgcatagctctggaacaccatgccgatcccgcgtttctgcgggctcaggggcacgatgtcatggccgtcgaggaggatcttgccggcgtccaccggggtcaggccggcgatgcagcgcagcagggtggatttgccgcagccggacgggccgagcagggtgacgaattcgcccttgtggatttcgcagttgatgtcgctgaacaccggggtgccactgtaatttttctgcaggtgttggacgctgacgaagctcattggcttttgtccttgttcaagatgttggcggcccaggtcagaaccagcacaaagaagaagtaggaaatcaccagcgcgctggtgaagtggccgctgctgttgcgcatgttgttcaggtaaacctgcagggtttcgtagcgggtgcccaccaggatgttggcgaacacgaactcgccgaacaggaacgagaacgacagcagcagggccaccatcaggcccttgcgcaggttcggcagcaccaccaggaaagccgcctgccaggtactggcgcccagcagctgggcggcgtccatcaggtcgcgcaggttgatcgcttgcaggttattggtgatcgcccggtacatgaacggcagggccacggtgaagtagcagccgacgaggatccacggcgtgccgaccatggcgaacggtcctgaaccgtagagttgcagcaggcccaccgaggacaccaccggcggcaccgcgaacggcagcaggatcaggatgttcatcagcgcatcgagccttgggaagtggtagtgcaccacgaacagcagcggcaggatcagcaccaccgacaggatcagggcgccgacgcagaccagcagcgactggccgaaggcatgcaggaagcgtgggtcgctccacagctggatgtaccacttgaaggtaaagccgctgggcaggatggtcgccgaccagctgctggcgatggagtagaccagggtcccggccagcggcagcaggaggatggcgaacagcaggtacaccacgacccggtgatagagggcggcggagctgggttcagcgcgagacatggtagctcctcttcaacagcagctgatggacgatggtcaccagggtcatcagcgccaccaggaccacggccagggcgctggccatgttcgggtcgagggagatgtcgccggaaaccatggcggcgatgcggatcggcagcacgttgaagttgccggtggtcagtgcatagaccgtggcataggcgcccagggcgttggccagcaggatgacgaaggtccccagcagcgccggggtcagcaccggcaggccgatgtggcgccagaactgccagccactggcgccaagcagtgccgcggactcgcgccagtcttcacgcagggcatcgaaggccgggtagagcagcagcacgcccagggggatctggaaataggtgtagaggatgatcaggccggtcttggagtacaggttgaagtcctgaatgatccccgcctgcttgagcatgatggtgatgctgccgttgaagcccagcaggatgatgaaggcgaacgccaggggcacgccggcgaagttgctggtcatgttggcgaaggcgttgacgaagttgcgcagcttcgagtcgacccggcgtagcgagtagctgccgagaatcgcgatgacgatgccgaacacgctcgaccagaagctgatctccaggctgtactggatggcctgcagatagaacctggaactgaagatcttgttgaaattggccaggccccagccgaactcttccgattgcaggctgttgatcagcacccagagcagcggggcgatctggaacacgatgaagaacagggcaaagggcagcaggcacaggatcgccagccatttgccgcgggtgaatgcattcacttcagcaactcccggcatacaggtttgtcgtggggcacgccgagcaactcgcagatggtgccgcacaactcggtctgatccggcgtggcgacggggctgaagctgaacgcatcgccgagaacgaacaacggcacttcccgctcctccggcagcaggccgttgtgggagcggtcgttgttcatgccgtggtcggcggtcaccagcacctggtagccggcgtcgagccagccttgcaggtaatcggcgaggatgatgtcggccgtgcgtgcgctgttgcggtactgcggggtgtcgaggccgtgcttgtggccggcgtcgtcgatgttcatcgggtgcaccaggagaaagttcggggcatggcgcagccgcaggtgttcggcatcggcgaacaggtgggaatcggggtagtggtcgttccagtagaaatgcccgtgctggatcggcagtttcttgttgtcggtatgccggtcccgggccgggttgaacggtgagcggttgtacagctcgctgatccagtgataggccgcggcggcggtgccgagcccggcggcgctggcgtagtggaaaatgctgcgctggttggacaggcgcgagacgttgttgtgcacgatgccgctgtcgatcggtggcaccccggtcaggatgcattcgtagagcggtcgggacagggccggcagttcgcattccagcttgtacagcgcggcgcgtcccgcgccgacgtaggcctgaaggtgtcccatggcatggcgggcgacctcatggttgaggccgtcgagcacgacaaggatgacgttgtgtgacattggggaggactccgcaagacaaccaggtgcctgtaggagcgagcttgctcgcgattgcatctctgcggttccaggacagaccgcggcgcctggatcgcgggcaagctcgctcctacagatgcagcattactgcatgttgatgatcacttcttcctgccatttctgtggcaggcccttggaggttttctcccaggcgtcggcgtccttgatcggcgtgactttcttgtactgctcgttgggcagcaggttggcctggacttcggcgggcagggtcaggtgctcggcgcggatcggacgggcattgccgcgcgccaggttgatctggccggcatcgctgaagatgtattcacgggtcagcttggccgcgttcgggtgcttggcgtatttgttgatgatggtggtgtagccggagattaccgagccgtccgacgggatcagcacgatgtagtcgtccttgttgaccatcttgttgcggtagctcaggccgttgaagtcccagaccacgccgacttccacttcacccttttccatggtggcgatggtcgggttggccagcgacaggcgcccctgcttggcgatctcggcgaacatcagcagcgccggctggatgttcttttcatcgccgcccttggcgatggccgcggccagcacgccgttggcggcctgggcagcggtgctcacgtcgccgatggaaaccttgtatttgcctttctccaggtcggcccagcttttgggggcttcggagccgtgcagcagcttcttgttgatgatgaaggcgatggtgccggtgtaggccagcgcccagttgccgtccttgtccttggcccagtccgggacctggtcccaggtgcttggcttgtaaggctggaccacaccctgcttgaccgcgatcgggccgaaggccgcgcccacgtcgccgatgtcggcgctggcgttgtctttctcggcggcgaacttggcgatctcctgggccgagctcatgtcggtgtcgatgtgcttgaggccgtactgcttggccaggtcttcccaggtccctttccagttggcccagtcgtcgggcatgccgacgctgttgacggcgccttcggctttcgccgcggcttccagggtcttcaagtcggtatcggcggccatggcggcggtgcacagggcaatggtcgagcctaacagtgatgccaggaaaagctgtttcatccgaagctcctttgggcgtgttcaacgctgtgtttgtctaacgttgttggtctaggtcagcaatacctgagccaatttaagccggctggatgacactttgatgtcggcatcagtcctgcaaggcgtttgcgagtgtctggcacgggtctgcgagataagcgtagcccagggctaaacagctgatatgaaaggacttggccagccaattgcaggtgtctggcaccgccatttggcggcgttgtcatctgtcagtcatatgcagtgcctaggctctcggtgaaggctgagtgcctttttcccaggcacgttttgccctgaaacagtgctggtctagtccagataggtaacgttgatgcgcgaagaggcagtcaaggcggtgacagccattgggcaggtcctgcaggaacagatcgatcacgggttgttggcacccggtagcaagctgccggccgagcgcaagctcagcgagttgttcggcactacgcggattaccgtgcgcgaagccttgttgcagttggaggcccagggccagatctaccgcgaggagcggcgcggctggttcgtctcgccgccacggctggcctacaacctgatgcagcgtagccattttcacgcgatggtcagcgcccaggggcgggtgccgtcgaccgagatgatttcggcgcgcctgcaaccggcttcagcggcggtctgtgcctggctgcaactgccggcgctgtccagcgtgatccagatccgtcgggtacgacgcatcgacgagcgcctggtgctgtatgtcgagcactacctcaatccgcagtacttcccgggcattctcgagttcgacctgaaccagtcgattaccgagctgtatgcccggcactacgacctgcattacgggcgggtgcgcttcgagatcgtgccgacctccttgccggtggaggccgcggcggcgttgaaggtttcggccggcagtcccgggctgcggatcgcccgggtcaattacgaccagcaccagcgcctgatcgactgcgacctggagttctggcgccacgacgcgatccatgtcggcgtcgatgtggtctgagcccgctcccggtgcgggagcgagcttgctcgcgatgacgccaggggccaatccttaaggtttggccccggcaaacagataatcggtggtcaatgacgccagggtacgcacgcccaccaccagcgccgattcatcgacaaagaaccccgggttgtggttcggcgcggccttggccatgtcctggtcccgcggtgtcacgccgagaaacacgaacaaccccggcgcctccttggcatagaaggaaaagtcctccgcgccccctaccagcgggccctgcaccacgtcgcccccggccgcccagcgcaggctcggcagcatcttctcggtcagggccgggtcgttgatggtcgggtcgtacttctcgatgatggtcacctcggccttggcgccgccgctttcggcgatcttttccacggtctggcgcacatcgctgtgcagcttctggcgaatgccgtagtcgtaggaacggatggtgccgctcatgtccagcgactcggggatgatgttgtagcgcgtgccaccgttgatggtgccgatgctgactaccgagggaaacgacgagatgtcggtgcgacggctgaccacggtctgcagcccgactatggcctgggcaccgaccgtgatcggatcgatgccgtcccaggggcggccggcgtgggtctgcttgccgaggatcctgatgcgcaggtcgtcggagctggccagggtcgggcccgggcgataggcgatgcgcccggccggaatcccggcccagacatgcaggccgaacaccgcgtccggcttgggcgattgcatcacgccttcctgcaccatcatcttcgcgccccagatgttcttgccgtcggggatgaaatcgctcgggccttcttcggcgggctggaaatagaacaccacggtgccgggcaggcgctcgcgcatgtcactgaggattttcgccgtgctcagcaggatggcggtgtgggcgtcgtggccgcaggcgtgcatgacgtccacttccttgtccaggtagcgccccttggccttggaggcgaacggcaggtccgcgacttccttgaccggcagcgcgtccatatcggcgcgcaaggccacggtgggaccgggcagggcgcccttgagcaccgccaccacaccggtgcgggcgacgccggtcttgacctccaggcccagggcgcgcaattgcgtggctaccagctgtgcggtgcgctgttcggtgttgccgagttccgggtgggcgtggatatcgcgacgggtttccagcagcgtcggctccagggccttggcctgttcggcgatgtgctggcgggcctgttccatggcgctgtcgtcgacagcgttggcggcctggccggacaaggccaggacgccgatcaggcaggcttgggcgatagcggatagctgcatagggactctctccatgattagtgttgtgctgctcaggtgccagaacctgtgaccgcccccaaccctggagagtgcgaccgcgcccttgccgaggcgcggccggacgccttactcctcttgctggggtccgccgccggcggtgatcacttgcacgctcatgcgtggcgtggccaggtccattccggcttcgtcgaggtgacgcttgagggacaggttgaaggcccgtgacacctcccattgcttgatcggcgcggtcttgaaacgggcgcgcagaatcgcgttgccggactcgaagctttccaccccctggaactccagcggcgaccagatgttgcgccgttgcagcgggtcggtacgcatcttctggccgacatcgcgcatcagtttgatggcttcgtcaatgtccatgttgtacggaatggccacccggaagatcgcgtagccgaactcccgggagtagttcttgatgctcttgatttcgctgaacgggatggtgtgcacgatgccgtcgatgtcccgcaggcgcacggtgcggatggtcaggccttcgacagtgcccaggtggccgccgacgtccacgtagtcgtcgatggccagggagtcctcgatgatgatgaacaggccggtgatcaggtcggccaccagcgactgggcgccaaaaccgatggccaggccgatcacaccggcaccggccagcagcggcgtgacgttcatgcccatgttcgccagggcgacgatcagggcaatgatgaagatcgccacgaacagcacgttgcggatcagcggcatcatggtctgcgcccgggcattggccaggcctttgcgcgagcgggtcagggcgtggtgcaccgcggtgtcgctgaggatccagatcagccaggcgaacagcagggtgccgccgaggctgaacagcttgacgctgatttcgtggccgtcgccttcggtgaagcggatcagcgacatgccccagacccgcaggccgagttcgatgaacaccagccacaccagcaggtgggcgagggtgtagaagaagcctttgaggcgctcggagtacagggcatggcgcttgtgcccgcgctggggcttgagggaatggcggcgtaccaggccgttgatcaccatgcacagcaccagcagcacggtgcagatcagcgactggcgcagtgcggtgctggtgtcgccggcggaaatgaaggtggcgaacagggaaatggccaccagtaccagcgctggcaggtaccagaaggtgccgatgatctcgatggtgtcgctcagggcgcggcgggtcaggcggcgggacagcggctggttgcggatcaggtgagcgatcggccggcggaaacgcaggatgaataccccggtggacaaggccgccatcacattggcgaaggtggccgcggtgtgcgccaggtggctgcccaggctggcaatcagccgtgggtcgctcaaggcctcgccgaaggcggcgaaactgccgatcaaccacaacggccggaacgcctggcgacgcaggatgtacaacgcgcggtgacggttcggaccgtccagcacggaaaaggcgatcacgcagatcgccgagaagcaggtgccgaccaccagcgcgtaagccaggaccatggccaggtccttgcccagggacgatggcagcttgtaggtcatgtatacggtcatgatcagcgcgatcagccagggccccagtttgcgcagggcgaagcgcagcaggtcccaggtcttggggtgttgcggcagttcttcggtgaggccgaaacgctcgcgcaggcggtgactgagccagatcagcgccgcggcgagaaggctccagaccatcaggatcagggcgaaggagaagatgatcggcagccattcgctggccggcagcatcagggccgccagttcatcctgggcctgatcgaattcgttcgaccagcgagtgatcgggctgtcggcgccggagaactgtttttcgaagctggacagggtgccgccgatcaggccgagcacgccttcttcggcgggcgtctgggccttcttcgtggcgtcgcggagttttttcaggtcggtcagcaactgggtgcgttgctggtcgttttccagggacttgatcacttcgtccagcgactgccccagaggctgctcggcttgtggctgggttttgccgctgttgagcaggcccggcagacccaccgcctgggccgatgacagcggcaatagtgtcaggagacagagaaacaggcagtagggcagaacggaaagacgagcgaacactgggcggtcaacctcagaaaaagcggatcgaccgagtgtacgaggcagccaataccaatgcgagcctggacggcggatttattcggcgagtttggcgaggatcttgtagatcacggtgccgaggatcagcagcataccggcccacatactgaagataccggcattcttgtcgcggaagttgtagccgatggccagcaggatcattcccgagagaatgggaatgagcatggcgtggaacgaagacatcgagatcatggcgacagccttgtcggaggggataatcctaagtctaggtggctttggcgaggttcgggttgatgtgcatcagaaatgctgcggcaccctgtagccactgccgcaggctgcgatcgcctgtaaaaacaggcgcaggatcttgagatcgctgaagcccttcgggcttgtcgcagcctgcggcagcggctacacggggcttatggcagatcgcggctggcgtagaacgcgctcaagaccttcaccagatgcgccaggtcgtggctgccgcacagttcgcggatcgagtgcatggcgaaagtcggcaggccgatatccacggtacgcacgcccaggtggctggcggtgatcgggccgatggtcgagccacaacccatgtcgctgcgcaccacgaagctttgcaccggcacttcctcggccatgcacaggtggcggaagaaaccggcggtttcgctgttggtggcgtagcgctggttgctgttgaccttgatcaccgggccggcgttgagtttcgggccatggttggcatcgtgcttgtcggcgtagttggggtgcacgccgtgggcgttgtcggccgagaccagcagcgacttctggatggtacgcacgaattcgtcgccttcgggcagcaggcggcgcagggtctgctcgagcatcgggccgtcggcgccgcaggccgagcaggagccgacttcttcgtggtcattgcagaccagcacgcaggtttcctcggtgtcggcgttgagcaaggcttgcaggccggcgtagcaggacagcaggttgtccaggcgcgcaccggcgatgaagtcgccatgcaggccgatgaccgccgcgctctgggtgtcgtagaaactcagctcgtaatcgagcaccacatcggcgttcaggccgtgttcgcgggccaactggtcggtcagcaccgcgcggaagtcgacccgctcgtcgccggcgaactgcgcgaggattggcggcaattcggtctgggcattgatggcccagccctggttggcttcgcgattgaggtgaatcgccaggttggggatgatcgcgatgggcgccttgaagtcgatcagctggctttcaaccctgccgtcgcggcggaaggtgacgcggccggccagcgacaggtcgcggtcgaaccagggcgccagcaaggtgccgccgtagacttccacgcccagttgccagaagccctggcgttgcagctccggttgcggcttgacccgcaggcacgggctgtcggtgtgcgcgccgaccatgcggatcccgccttgcagaggcgaatgccgccccagcttgacggccacgatggaggagtcattgcgggtgacgtagtagcgaccgttggcttcggtggtccacggctcgcgctcgtcgagacgctggtagcccgcggcctccaggcgttgtacgaggctggcggttgcatggaaaggggtaggggaggccttgaggaagtcgatcaggccctggttcaactcttcgcgcataagtaactccagacagcagtggcgcgagtttaccgtatcggctcgcggcattgcaggcgcaatgccgttgagggagacaacattcatcgcggcagggaaaacggctcaaccggtgatcaggttgcctttgaggaatacttcgcggcgttgcttgcgacccacatattcatgcttgctggcctggtaaacctcattgaatttctctgcgcaaatgcccggcagttgatcgaggtattccttcaccagcgcatcgtactgcgcttcggtgatcagtttgtagacttcgcggcgatagaagaaacccaactgaaaacccagggtttcgctggcgtggggcgtgatggtcgcgaagcagttctcgaagtcgatggccttgagcggagcctgggggctgatcatgatgttgccggcccagaaatccatgtgggtgatgttcttttgcgcgagggagtgcagcaggccgaatgcatcgcggataaaaggctcgatcttgtccgggttgttgcgcaaccactgtacgccgtcgacgtaatcatccagcaggcgggtaaggatgaagtattcctgtaccagccccaggcgatcccgggtatagccgaacccttcaaggtcggacatctgtacgccgcgtcgctgggcttcgacggtgttgatcagctcttccagcggccagtcgaagcgaccgttgcgctggggcttgcccagggtgacgcgaactttcgccttgagcgtatccaggggctgcaccttggcgaacagcggtgtctggccggtcgccaagggggcgctggcgcgggtctgtttgtgtgcgtggcgttggcggatgagttgttcgagggctgcgcaggcgtctgccgaaggtttttcgcgaaggtgcagggtggtattcaggaagcagaaggtgaaggggtaatcgcgttgaaatggctgactgctgagcacggggcttcctgtcttaatgtcgaatagccactattttaatattcttttcacaaattcataacaaattattcagattaatcttcaattttgatcggatttttccgtacctgtgtgcccctcaatcgaggggcgtcccgctgcggtggccgctctcgatcagaacggtgccgggcactcgaagcgcaggcgttcgctgctctgcggatgggtgaagctgagcatgctggcgtgcaggcacaggcgtggccaggcggccagcgcttgcggatgcgcgtacaggccgtcgcccagcagtgggtggccgatggacagcatatgcacccgcaactggtgcgagcgcccggtgatcggggtcagctcgacgcggcaccagtcgccgcagcgttccagcactcgccagaaggtcagggcgttcttgccgaattcgtggtccaccacgtgccgcggtttggtcggcgggtcgtagcgcagtggcaggtcgatgctgccgctgtccagttccggctggccccagcacagggcggtgtaggctttttcggtctcgcggtcgtgaaattgccgggacagttcgcgatgggtatcggggtcgcgggccagcaggatgatgccggaggtttcccagtccaggcgatggacgatgcgggcttccgggtagccgttttcctgcaggcgggtgatcaggcaatccttgttgtcatcggcccggccgggcacggagagcagcagggtgggcttgtccaccaccaggacggcggcgtcctggtgaatgatgcggatattcgacagcggcattaaaacagcctcgtaacaaacgccaacggcggctcgatcaacccggcttctacaggagcacgtgtgctcctgtagaaaaaccgagggaccgagccgccgtggctccagccgaatcgatcagcgatcgggcagggtgatattgagttccaggatcgagcagctgccctggttttccagggcgacatgcacgtcatcggacccgatattgacgtacttgcggatgacttccaccagttccttctgcaaggcaggcaagtaatcaggggtagtgcgctggccgcgttcatgcgccacgatgatctgtagacgctctttcgctaccgacgcggtgcttactttcttgctggcacgaaagaagtcaaaaagattcattacctacctccaaacaggcgctcgaagaatcccttcttctcaatatcaaggaaccggtgttccacggttttacccagcagacggtcgacagcatcgctgtacgcctggccggcgtcgctctggtcatcgagaatcaccggaacgccttggttggaagccttgagtactgcctgggattctggaatcacgcccagcagcgttactgcgagaatctctttgacgtcttcgacgccaagcatttcgccgttgctgacacgcgaagggttgtagcgggtcagcagcaggtgttccttgatcggatcttcgccgttttccgcgcgcttggacttgctggccagcagacccagcatgcggtcggagtcacgtaccgaggaaacttccgggttggtcacgacaatcgcttcgtcggcgaagtacatggccaggtgagcacctttctcgataccggccggggagtcgcagaccacgaattcgaaggtctccttgagctccatcagcactttttccacgccttcctgggtcagcgcgtctttgtcgcgggtctgactggcggccagtacgtagaggttttccaggcgcttgtctttgatcagggcttgctgcaggttggcttcgccgttgaccacattgacgaagtcatacaccacgcgacgttcgcaacccatgatcaggtcgaggttacgcaagccgacgtcgaagtcgacgatgactgttttgtggccgcgcagagcgaggccggtaccgatagcggcgctggtggtggtcttacccacaccacccttgccggatgtaaccacgagaatcttggccaaggtgtttcacccctaaggaaaaaggacttttagcccctgaaaaacatctcttgaaaactactgcagtcggacagccttggctggaggtcggttaacacctgctcctacttcgtttgagccgtattcgctacgttttagagatgcttggaaaatgcggcagtatccgttaaagacgtgtgatgttcaacacgtcacccgacaggctgacctggaccccggcaccccacaacggatcgcgccgcaggtcctcggaaaccttgtactggccggcgatggacaccagttcagcgctcaattgctgacagaaaatccgtgccttggtatctcccttgaccccggccagcgctcgaccgcgcatcgggccgtatacatggatgttgccatcggccagaagttccgcacccgggctgaccgaggaggtcacgaccagatcgccaccctgggcatagatctgctgcccgccgcgtactggcgaagtgatgatgcgggtgggtttgatggtcggctcaggcggcctttcaggctttttccgggcttcgctttcctgcggttccagcggccgctcccgggcgccggaaggcggcagcacgggcaggtcgacggcgatcgccgcggcgatgtcttcgatgcggctggcgcggatcgccagggtgcgcaggccatggtgacggcagacgcgcatcaggcggggcagatcgacggcgccttcgctggccggcagcttgtccagcgccagcaccagcggggcgttactgaagaaattcggggcttgcgcgaccttcgccgccagttggcgatcgaggccctcgaggtcgttgcgggccagttccagcacggtgatggccagcatgctgcccttcaactggaacacaggatccaggtcttgcgattcggtttggctcatggtcggcataaagcggcttgtcactaaaagtgccgagacttataacgagaacgcccgcgagccgcaagccgggtcgaaccgatgtagaatgcgcgaccttgttgtctgtccggaatctgtaatggatcgcccgcgttttcgagctgcatttctttatccccgtttttggccgctgtggctgggcctgggcctgctatggctggtggtccagctgccttatccgttgctgctgtggatcggccgtgccctgggcgcgctgatgtaccgggtggccggtgagcgccggcggatcgccaagcgcaacctggaactgtgtttccccgaaaagtccgccgccgagtgcaagcgcctgctcaaggaaaacttcgcctccaccggcatcgcctttttcgaaatggccatgagctggtggtggtccaagccccgcctggcgcgcctggcccatgtcgaaggcctggagcatctcaagcaggcgcagctggaaggcaagggcgtgatcctcatggccctgcacttcaccaccctggaagtcggcgcggcgttgctgggccagcagcacaccatcgacggcatgtaccgcgagcacaagaacccgctgttcgatttcatccagcgtcgtggccgcgagcggcacaatctggattccctggcggtggagcgtgaagacgtgcgcggcatgctcaagctgctgcgcgccgggcgggccatctggtacgcaccggaccaggattacggcgccaagcagagcgtgttcgtgccgctgttcggcatccaggcggcgacggtcaccgccaccagcaagttcgcccggctgggcaaggccctggtggtgcctttcactcagcagcggctggccgatggcagtggttatcggctggtgattcacccgccgttgcaggatttcccgggtgagaccgaagaggccgattgcctgcgcatcaaccagtggatcgagggtgtgctgcgcgagtgcccggagcagtatctgtgggcgcaccggcgcttcaagagccgcccgccaggcgagccgaagctgtataagaagcgcggttgaaattatcacgctagattgaaagccctttatcagcgccatggagtgtagcgatgagcccagcggaaccggtcacaggattgattctttccggcggcggggctcgtgcggcatatcaggtgggagtactggcggcgattgccgaattgctgccggcgggggcgagcaatcccttcccggtgatagtcgggacctcggccggggcgatcaatgcggtcagcctggccagcggcgcgctggatttcactgcggccatcgagcgtctcacggcgttctggcagggctttcgcagccatcaggtgattcgcagcgactggcccggagtgatccgccaggccacccggttcgttggccacagcttgctcggcctgggcgcgcaagtgccggtggcgttgctcaacagctcgccgctgcggcagttgttgaacgataaattgcagctgtccggtattcgtcatgccattgcgcaaaagcatctgcaggcggtggcggtcacggcctttggttatgaatcgggccaggcggtgaccttctaccagggcggcggcaccatcgaggcctggttgcgccatcgacgtatcggcctgcccaccgaactcacggtcgaacatttgctggccagctcggcgattccactgctgttcgcgccggtgaaaatcgaccaggagtttttcggcgacggcgcggtgcggcaatcggcgcccatcagcccggcgttgcacctgggggccagccgggtgctggtggtcggggtcagcggcaacccccgtggcatcgatccgcaggcgccccagcaacgcagctacaccgggcagcagccgacgctggcgcagatcggtggccacatgctcaacagtacgttcattgacagcctggagagcgacatcgagctcttgcagcgactcaaccagttcagtcatctgctgccgtcggggacgcccgtccgcaccctgggcgtggcgccggtggaggtgctggtgatcgctcccagccagccgatcgacgagatcgccgcgcgtcaccggcatgagctgccggcggcattgcgtctgttcctgcgcgggccgggggcgaccaagaccagcggtgccggggtcttgagttacctgctgttcgaggcggggtattgcagcgagttgatcgagctggggcgcagcgatgccttggccaagcgcgacgagctgcggcggttcctggggttggcggcagaggtcgcgacggcctgaaagaacatcgcgagcaagctcgctcctacagggagttcattatctctgtaggagcgagcttgctcgcgatagcgtttctaagggcaatgctcaggccgtcagtttgtcgtcgcgaaaatcccgcaatgcctgctcgatctcttcccgggtgttcatcacgaacggtccgtactgcacgatcggctcgcccagcggcttgccggcgatcagcagcacgcgggcgccgttggcactgctcaactgaatctcgccctggtcggacaggcgcaccagcttgctgctggcaaccggttgcggatgcccgggcaggtcgatctggccttcatagacatacagcagggcccgatgcccttcaggcagccgcgggctgacgctggcgcccgcaggcaggcgcaggtcgaagtagtggggctcggtgtccggccgttcgacggcgccggtctgctgcgcctggccgtcatcgaagcggccggcgatcaccaccacttccacgccattggcggtggtcaggcgggggatgtcctggggttgaatgtcccggtagccggccttgtcgagcttgtgcttgcccggcaggttcagccatagctggaagccgcgcatcacgccttcttcctgttccggcatctcgctgtggatgatgcccttggcggcggtcatccattgcacgccaccgccttccagcaggccgacgttgcccaggtgatcctcgtggcgcatgcggccttcgagcatgtaggtgacggtttcgaagccgcgatggggatggggcgggaagccggcgatgtagtcgtcggggttttccgagccgaattcatcgagcatcaggaacgggtcgaagcgctcgacaccctggccaccgaagacccgggtcagtctgacgccggcgccgtccgaagcgggctggccggtatggacgctgagtactttgcgaaattgagtcattgatgcaactcctgatcaggttgggatgagcgacatgctatgccagctcaactgatcgatggttgcgaatatcggcgcgttgctatcgatttattcgatgtaatccgttcccgcggccggcacgggaacggcgctcactgcattagaagtggtacttgagcagcaggctggcggtgttctggtcggtgtcgaagtagggggtgtccttgaccccgtacttgttcttccagtagtcgtattcgataccgacatacaactgtttgtcgcccagtttcagcgccttgcccaggtcgtacttgatctgcgggttgatgtgcaggttggcgtggtactcgcctttggcgttcttgtcgttgtccaccacccagtcgatgaaaccgtcgatcaggatgtcagaacggcccacgggaatggtgtaggaccagaccggagtgatctgccagacattgtcgccggcacggctgccttcggtctggcggttgtagaagttcaactggaagtaatcgaacccggggatcgccaggtcgaaacccggaccgatcaggtaggactcgttatcgccttcgccgaactcgtaagtcatggccagcaatacatcctttatcgggccgaactctaacttctgatcgaagatcttgccgaatgaaagacgcgggctgaactcgccgtaataagtgttcgggccgacgttgccgtcctttttgccgttgtagaagatcttgtcgataaacaggaagttgtcgccgtacttccaggcatcggcatgttcgaaagtcacggtttgctggatctgcgggttgatcgtgaagtctttgccgtagaggtaggtcaggctgttgttctgccattgcagcagttcgcctgcggtggcctgggcccctgccagcaaggatccggcaagcatcaggcctttacagatgcggttcattcggttgctcccaaaaagtaagtggttccacgttttctttaaaaaccggtgctctggtgtggcaccttttagtggctgaaaaatcatccgatcggtcagctttgttgctgatagcaagagctgagccaaggcgaaaaaaaagcgcaaaaactcccgcgcgtctgtacgaatacagtcgatcgagagtgaattcggttttaactcggtacgccttggtactttccggaggccgggagaagttggctttccggtcaggttttaaatccgggctttttttttcaccggattcaggcggccgcggagaatactgactcccacggccttgctcaagtgctctgcaatagcgcacttgaaacaactttggggcacgtttgccggtcattctagaaatgcaccttcaccagcaggctggcggtgttctgattggtgtccaggttggcgctgtcctgaatgccgtatttgtctttccagtagctgtattcgagaccgacatacaactgcttttcgcccaggcgcagggccttgcccaggtcgtatttgatctgcgggttgatatgcaggttggcgtggtaggtaccgcggtcgttccggtcgttgtccaccacccagtccaggtagccgtcgatcagcaggttcgaacggcccagcgggatgctgtaggaccaggagggagtgatctgccagacaccgtcgccggggcgcgggccttcggtttggcggcggtagaagttcagggtgaaatagttgaagcccgcaacggccaggtcgaaaccgggaccgatcagataggcctcgctgtcgccttcgccatattcgtaggtcatggccagcaacacatccttgaccgggccgaaggcgaatgagcggtcgaggatcttgccgaacgacagcctggggctgaactcgccataaaaggcgtggggacctttgttacggtcttcctcgccgttgtagaaaatcttgtcgacgaacaggaaggtgtcgccgtatttccaacggtcggcgtgttcgaaggtcacggtctgctggatcgacgggttgatcgcgaagttcttgccatacaggtacgtcaggctgttggtctgccacagcagcaggtcgccggccatgacctgggtcgtggccagcagtgcgccgccgagcagcaggcgtgcgtgtgcatgtctcatcgtgttgctccctgtttgtttttattgtcaaggcgcaggcagccgccgactgcgaccgggcgcggtgccgggtctgcctgtcgtgcgtgtatttcgggtatcgacggtcaagcaggggcggctgtcgggccgccccgtccaggcttcaatgctggtggacgtgtcgggcgttgctggcggcccgttcggtgccgcccaggatgttgaacagcaggttcagggccagcgcactgagggtggccatggcgattccgctgtgggtgatcgggctcatccacaggggcaggtgggcgaagaactccggacggaccactggaatcaggcccatgccgatgctcaccgccaccagcagttgattgcgccggtcggcgatatcggtttcctggaggatcttgatcccggtcgccgccaccatgccgaacatggcgatagccgcgccacccagtaccgccgggggaatcgaggccaccaggaaagccgccttgggcagcaggctcagcacgatcagcaggccgccggcgactatggtcaccgagcggcaacgcacgccggtcatctgcaccaggccgatgttctgggcgaacgaagagtgggtgaaggtgttgaggaaaccggcgaaaaacgaggcgccggcatcacacagcaggccacgacgcagcatgcgcggggtgacttcctggccggtgattttccccagggcgaggaacatcccagtggactcgacgaagatgatcaccaccaccaggcacatcgaaagaatcggcgccagatggaactgcggcatgccgaaatgcagcggagtgactacctgcacccagggcgcctgggccatgccgctgaggtcgaccatgccgatcaggccgcagagcacgtagcccaggcccatgccgatcagcacggaaatgttcacccagaaaccgcgcatgaaacggtgcaccagcaagatggtgcccagcaccagcgcggcgatggtcaggtagatgggggaaccgaattcggcattgtggctgccgccgcccgcccagttcaccgcgaccgggaacagcgacaggccgatggaggtgatgacggtgccggtgaccaggggcggaaagaagcgcaccaccttggacatgaagggcgcgatgagcatgccgaagaaaccggcggcgatggtcgcgccaaagatcccctgcaggccgatgcccggcatgccggccatggcgaccatgctgcccaccgcggcgaagctggcgcccatcatcaccggcatgcggatgcccatgggaccgatgccgagggattgcacgagggtcgcgatgccggcgaccagcaggtcggcattgatcaggaaggcgatttcttcacgactcagacccgcggcctgtccgatgatcagcggcaccgcgatggcgcctccgtacatcagcaggacatgctgcaacccgaccaggatcagttgcaaaaggggcagtcgcgcaatggcgggtgcgtcggggatgcgcggttcgtttaacgcggacatgcaacacctcggatcttcttattcttgtgattagaaagctgtgtggttgcgaacagcttttttgcagcaggccaaccgcgtggcggtcgatcgcgagcaagcttcgctcctacagaagcaacacacatgctgtaggcgtgaggcttgcccgcgatagcggtcgtcaggcaccgcagtattagttggtgcgcgccccctggttgatccaggcgccgatcaggtcacgttcctgctgggtcatctgggtgatgttgcccagcggcatgatctggctggcgactgcctgggcctggatgcggggggcctggagcttgatctgctccggggtgtcgaacatcacgccggccggcgcagcactgaacagcgggctggtgggcttggccgagtggcagacggtgcaacgctcctggatcacgttgtgcaccttgtcgaaggtcgggccctgggttgccgtggacgcttgtgccggggccacttcgggagtcgccggagctgccggagccgcggcggtttcaggcttggcgccgccgccgatggcggtttccggcagtggctggtactcgatcttcgccggcgccttggccacttccgggctgttggccatttgcgcggggccggtgacgtaggccaggcagatcatgcccagggcggcgaccggcagggtccaggcgaacttgtggctgtcgtggcgggtgttgaagtagtgacgtaccagcaccgccagcaccgcgatcccggccaggatcaaccagttgtactggctgccgtaggtgctcgggaagtggttgctgatcatgatgaacagcacgggcagggtgaagtagttgttgtggcgcgaacgcagcaggcccttggccggcagggtcgggtccggcgtgcggttttccgcgatggcggccaccagcgcgcgctgggccggcatgatgatgcggaacacgttgccgaccatgatggtgccgatgatggcgccgacgtgcaggtaggcgccgcgaccgctgaacaccttgctgaagccataggccgcggcgatcaacagcacgaataggatgaagccgagcagggcgggtttcttgcccaggggcgagtcgcagaggaagtcgtagacaaaccagccggcgatcagcgaaccgatgccgatggccacgccttcagggccggtcaggccgctgccgggcgctaccaggtagagcatcgggttgtagtagaacaccaggcacagcagggcgatccccgacatccaggtgaagtaggcttcccacttgaaccagtgcaggttctccggcatggacggtggggccagtttgtatttttccaggtgatagatgccgccaccgtggattgcccagaggtcgcccgacaggccgtccttggggttgatgcgattgaggttgttttccagccagacgaagtagaacgacgcgccgatccaggccacgccagtgatcatgtgaacccaacgcacgctcaggttgagccattccaacagatgtgcttccacagtctttacctctcgcctgtcacccttgttttcgggtgatcagaccttctcttattggtggggggcgaggatcaaacactcatcctcttcaaagaaatgctcatcgcagttgttgcctgtgccactgcgatcaaccaccaggaagtcatcccgcttttcgatcgtcagcaccgggtggtgccagacgccgcgatggtaattaatgccctgcctgccattgctgacgaaggcgcggaccaagcccgatacaggtgcatcgccaagtggcgcgaccacgatcagaaagggattgccgagcagcggaatgaaagcctggctgcccagcggatggcgctccagcatgcggacggtcaagggcatgtccagcgcgtcggcgcggaagatgctgatgatcgccttgtcgtccggcgtggcggtttccacggtagccagacgatggaagcgcatggtcgaaccgttgttgatcatgaagtgatcgctgccgtcggtttcgatcacgtcaccgaagggggcgaaggcttctttgctcagcggttcgatcatcaatgtgcgcatgctgttcttcttaatctgtgagttcgttgttgtcggtgaatcatctttcccacaggagcgagcagcctcgctcctgtgggcgcagcattacttcgacttcgcgaccttgccgaggatccgcaggcggctgacgccaccgtccgggaacacgttcaggcggatatgggtgatcgggcccagggccttgatctgctcggcgaaggtgtgttcggcgtgcatttccagcttctggctcggcagcagttcacgccagaacagtgactgggtttcgatctggctgtcggtaccgcccttgacgaaggcgccctggatcgagcagctgtccgggtagttgcccttgaagtgcagggtgtcgacgatgattttctcgatctcgcccggatggcccagggcgacgatcacccagtcattgcctggcgtgcggcggcgtgcggtttcccagccatcgcccatgttgatgccgcggcccgggttgaggatgttgctcatgcggccgaagtgttcgtcggagcaggccagggcgcggccgccgttgagggcggctgccaggtcgatctgctcgttgtcgccgaccgccgaccagtcgcggtacggaatgccatacacacgcagacgggccacgccgccatccgggtagatgttgaagcgcaggtggctgaacgcctggtcgttgctgatctcgtggtagtggtggctgttgccttgcagctcgacggccgacagcacttccacccactgggtgttttcattcggttcgccttcggccaggaagcaggcttccagggaggccgacggtgggaagttgccggtgaagaatgaggtgtcgatgtccacgcctttgatctggccaggcacgcccaggcggatcaccgcgctgtcgtagccttcgaagcgcttgcggcgcgactcccagccgtccatccacttgccgttgtcatcgaaaacgccctccttccatacggccggggtcggctggaacagacggttggcgtcagcgaaccagtcatcggtcaccgagatgatcttggtgcccaggcgggcgtcggccaggttgacgaatttctcgaaaggtacggcgtaagctttcattcttcttgtctgcctttttatagagtggcttgggatgcttgctggccctgtgtgctttgcactttgcacaggggctgctcgctaaagagtcagtaatcggaacagggcgatcttgttgatctccgccagcgcgcacctgaattcggtgtccaccgagttgtggatgcgggcttcgaacgccgcgaggatctgatgccggttgctgccttttaccgccatgatgaagggaaacttgaacttggccttgtaggcgtcgttcagctcggtgaagcgctggaactcttcggccgtgcattggtgaataccggcgccagactgttcttcagtgctggccgcggtcagttgcccctggacggcggctttgccggccaggtccgggtgagcgttgatcagggccagctggctctggtggtcggcgctcaacaggatgtcgctcatgcgctggtgcaggacgtcgatccggtcgatcgaggcatcctggcccaggtcgaaggccttttcggcaacccatggcgaatgttcgtagatgtcggcgaaggctttgacgaaggcgtcgcggctcagggtcgagggtttcagggtttggaaggtgctcatttcgccgcccccgggaacggatgggtttgctgccagtggcgggcgatgtccacgcggcgggtgaaccagacctgatcgtgacctttgacgtactcgataaaacgcttcagggcggccaggcgcgccggacggccgatcaggcggcagtgcaggccgatggacagcatcttcggcgcctcggcgccttcggcgtacagcacgtcgaaggcatccttgaggtactggtagaagtcgtcgcccttgttgaagccctggacctgggtgaaacgcatgtcgttggtgtccagggtataggggatcaccaggtgcgccttgccggtggggttgttggcttcccagtagggcaggtcgtcgtcgtaggtgtcgcagtcgtagaggaaaccgccttcttccatcaccaggcgccgggtgttcgggccggtgcggccggtgtaccagcccagcgggcgctcaccggtgatttcggtgaggatgcggatcgcttcgagcatgtgctcgcgttcctgggcttcgtccatgtactgatagtcgatccagcggtagccgtggctgcagatctcgtggccggcctcgaccatggcgcggatcacgtccggatggcgctgggcggccatggcgacggcgaagatggtcaacggaatgtcgaattccttgaacagcttgaggatccgccagacgccggcacggctgccatactcgtacagcgattccatgctcatgttgcgttcgccctgcaggggctgggcggcgaccatttccgaaaggaaggcttccgactccttgtcgccgtgcaggatattgcgctcgccgccttcttcgtaattgagcacgaacgacagggcgatgcgggcattgcccggccagtgagggtgaggagggttggagccataaccgatcaggtcgcgtgggtagtcagcgctcactgcagtcttccttcttatcgtgataacggtggcgtggcggggcctggggggaaggacaggctggcgtcacagcgatgggctgattgtatacaacttttaattcggtttgtaagcccgattttttgcatttttcatcgattgtgttcatgcctgggtactgcaagaaacctgcctggttggtcagctaatggataaaaagtcttctgtcctcatggtgtagccgctgatcaagggaatacgggagcttgctcgaagtacccggaaatgggtgatttttattgtgtacaatttttttgaaaagtgtcttaataaattcctcgccgcatcctttcgtgctccgaaacggtgcggtctccttatcaactgacttcaggaggcgcgaggtctggacgtgtgagcgcgcacagacacgcagaatcaatgggacgtttgactacacacgtgttggatgccgcgcatggctgcccaggcagcgccatcaaggtcgagttgtaccgggtcgaaggtacgcagctggaactggtcgccagtgctctgaccaacagcgacggccgttgcgatgcgccgctgctgcaaggcgatgactaccgcaccggggtttaccagctgcaattccatgccggtgattactaccgtgcccgcggcgtacaactgcccgaacctgcgtttctcgatgtggtggtgctgcgctttggcatctcggccgagcaggagcattaccacgtaccgctgctgatctcgccctacagctattcgacctacagaggaagctaggactttccccccacgaagcctgcgcaaatagcttctttggtctttcgcccgctcacactgcgggctttttttcacccttgagaaaggggtgtctgggaggatgtcatcgcgagcaagctcgttcctacagagctactgctgtaaacctgtaggcgcgaggcttgcccgcgatgctttcagcggctcaacagcgacgcggcaccggcgccgctgaacagcccggcgctgacccggttgaaccagctctggcccttgccgctgcgcaggtagcgcgccgcgccgtgggcgcccaggccataagccagcttgcacagcaggtcgagcacggtccaggtggcgatcatgatcagcaactggggcaggaagggctgctcggcactgagaaactgcggcagaaacgcggcgaagaacagaatgtctttcgggttgctggcacccagcacaaaagcgcgcccgaacagtgcgcgaaagcgtggttttggtgcggcctcgggcacttcggcgccatgagacggctgccgcgattgctgccagctttgccaggcgagatagaacaggtacagcgcgccgacgattttcagggcgctgaacagctgctccgaggccagcagcagggcgcccaggcccagggccgaggcactcagcaggcagatcgaggcaaacacgccgccgagaaacgccgggtaggaccggcgcaaaccgtaattcagactgttgctgatcatcagcagggacagcgggcccggaatcaggatcaccaccagtgcggcgccgctgaacagcagccaggtttccacgctcattgcctttctccttatgcgcaaaagcctcacccgacggggtgaggccgtttgaaaccgatgtacttacaagaaaatgaacttggcgataaagatcgcgcacagtacccacaggctgatggagatttccttgtacttgcccgtcccggccttcaagaccacgtatgtgatgaagcccagggcgataccgtcggcaaccgagaaggtcagcggcatcatgatggcggtcacgatcgccgggatgctgtcggtggcctcttcccaatcgatgtgggccatgccgcccatcatcagcatcgccacataaatcagcgcgccggcggtggcataagcggggatcatgccagccagcggtgcgaaaaacatggctgcgataaatagcacacctacggtcactgcggtaagaccagtccgaccacctgcggcgacgcccgcggcactttccacgtagctggtcacgggcggaacgccgaccaccgcgccgaatacgctggaggcgctgtccgccttcagggcgcgggagaggttctcgatcttgccgtcggggttgaccaggccggcgcgctgggccacgcccatcagggtgccggcggtatcgaacatgtgcacgaagaggaaggccagcaccacgctgatcatactgacgttgaacaccccggccacgtccatggccatccaggtcggtgccaggctcggcggggccgacatgatgccctcgtagtgcaccaggcccaggccccagccggccagggtcacggtgatgatgctgatgaggatcgcaccgaacacccggtgatagctgagcacggcaatcatcaggaagcagatcgccgccagcagcgggccgggttcgcgcagggagccgagcttgatcagggtcgccgggctatcgaccacgatgcctgcggtcttcaagccgatcagccccaggaacaaacccacgccggcgcccatggcgaagcgcaggctggccggaatgctgttgagcagccattcgcggatccgcgagaaggtcaggaacatgaacagcacgccggagacgaacaccgcaccgagggcggtttcccagttgtaacccatggttccgaccacggtgtaggtgaaaaaggcgttcagccccatgccgggagccaggcctaccggccagttggcatacagccccatcaacaggcaacccagggccgcggcgatgcaggtggcgacgaaggccgcgccgtggtcgatgccggcgtcggccatgatgttggggttgacgaagatgatgtaggccatggtgatgaaggtcgtcagaccggcgatcaactcggtcttcaccgtggtgccatgcaacctgagtttgaagatgcgctccagccagccactgttcagcggcggcgagagttccagcgtaggggcttcggatttgcggctttccacagcgagtactcctcaagagttttattatttttccagagccgggcacgtgagggtgggcagcggctctttgaggcatgtaaggcttgcgggcttttattgacctttaggtcaggaactcgcacgtggcgaattatgcttttgtatacaaagaaagcaaataatgttttttatgttgtatgcgaaaagttcgccagaaaggctatatgccctgtagccgctggcgcagcctgcgatcgagcgcgcagcggtcgtaatggggctgacgcggtccagcagaagcatcgggtatgcaggttgacgaccgctgtgtgctcgcgggctggggtgtcagcggttgtcgcccagagccttgttcaccgccagccagccatccactgccgcctcgccggcctcggcgaatacccgttgcagcagcttgacctgctcgcgccgcagcgattgctcaaagcgcgcgccgtcttctgtcagctccagcaggcgtttgcgcttgtcactctgcgaggcaacgctgttgaccaggtgcatctccatcaattggcgcagcgggatattcagcgcctgcttgctcacgcccagtgccgtgagcagttctttcacgctcagccccggatagcgggcgatgaaaaacacgatgcgctggtgcacgcgactcaggccgcgacgctcgagcatttcgtcggccttggcggtgaacgcctggtaaccaaagaagaaggcttccatggcggcttgttgggtggtctggtttttaaggtcaagcatattgacgtatctgcgaaagtcggcgtaatttcggtcaagcagtttgacgtattttcctccgcctttgctacgggtgacctcatggccttctccgaacgtgtctcgcgtcttaaaagctcactgatccgtgaaatccttgccgccgcgcagcgtccggaagtgatgtcgttcgccggaggcctgcccgccgaagcgatgctgccgaagaccgattggcaggcgatgccggtgtccatggggcaatacggcatgagtgaaggcgagccacagctgcgcgaggccctggcggcgcaggcccgggcgctgggcgtgccgtgcgaggccagccaggtgctggtggtcagcggctcccagcagaccctcgatctggcggccaagctgtacatcgacaagggcaccgagatcatgctggaagcgccgacttatctcgcggcactgcagatattccagctgttcggcgccgattgcctgaccgtgccgcttcaggccgatgggccggatctggcgcaattgcgcgcccgcctggagcagcatcgtcccgcgttcatctacctgatcccgaccttccagaatccttcggcggtacgctacagcgaagccaaacgcgatgccgtggcggcgttgctcgatgagttcagagtgaccctgatcgaagacgagccttaccgcgaactgacgttcgatggcggcaacgccacgcctattgtcgggcgcctgcgcaaggccagctggatctataccggtacggtgtcgaagaccctgctgccagggttgcgggtcggttacctgatcgccagcccggacctgtttccccatctgctgcggttgaagcaatcggcggacctgcacaccaaccgcatcggccaatggcaggcgctgcaatggataggtaccgagcagtatcagcagcacctgagtgaattgcgcgatttctaccgggtgcgccgcgatggttttcaggccgccctgcaccgtcatttcggcgatctggctgattggcaggtgccccagggcgggctgtttttctggttgaccttgaaacagccgctggacacccgcactttgctgaaagcggcgctggagcaggacgtggcattcatgccgggcgaacccttcttctccgagccggaccgcaatccaggtcacctgcggttgaatttcagtcatatcgatccggcgcgtctggacgaaggtctcaagcggctggccaccgtggtacgtcaagcacaggctgcacaggcagcctaaggggagagggccatgtacaaggtttatggggattaccggtccggcaactgctacaaggtcaagctgatgctcaatctgctcggtcagccttacgagtggcacgcggtggacatcttgaacggggacacgcagaccgaggcgtttctggcaaagaaccccaacggcaagatcccggtgctggagctggaagacggcacctgcctgtgggagtcgaacgcgattctcaactttctcgccgacggcagcgaattcctgccgagcgagccgcgtttacgcacgcaggtgctgcaatggcagtttttcgagcaatacagccatgagccgtacatcgccgtggcacgtttcatccagctctatctggggctgccgcaagaacgccagcacgaatacgagaagctgcaaaagcgtggttacaaggccctggatgtgatggaacaccagttggcgcgaacgccgtatctggtgggcgagcagtattcgattgccgatatcgcgctctatgcctacacccatgtcgcccatgaaggtggcttcgacctggagcgctacccgggcatccaggcgtggatgcagcgggtggaaagccatccgctgcatgtcgggatgctcgactgagctggtgctggaaacaaaaaaccgacccttgggtcggttttttatggtctggcgcttgtgggccagccggcgattgcgcgtttcaggcggcggagaaacgcttgtccagataatcgatgatcactttggactcgtacatccaggtggtctggccgttttcttcgatacgcaggcacggcaccttgatcttgccaccttgctccagcagggtctggcgatcctgttcgttgtttttcgcgtcacgcagggccaccggaacgttcaggcggtgcagggtgcggcgggttttcacgcagaacgggcaggcgtggaactggtacagggtcaggcccttggcggcctgttcgacctgggcttgagcggcggcggggcgctgctgcttgcgtgggcgggtgatgaagtcgatgaagatgatgagctggcccaggccgactcgaagcgctttgacgatcacgatattgcctcttgcccatgaaagaaggggcggcagcttacctgatttttgccaggcgaaaaaaaaccggcgatgaacgccggttctttcgggcagccgtttacttgatcaggctgagaaactcgctgcgggttgccgcgttttcgcggaactcgcccagcatcaccgaagtgatcatcgacgagttctgcttctccacaccgcgcatcatcatgcacatgtgcttggcctcgatcaccaccgcgacgcccagggcgccggtcacttgctggaccgcgtcggcgatctggcggctgaggttttcctggatctgcaggcggcgcgcgtacatgtcgacgatgcgcgcgactttcgacaggcccagcaccttgccactcggaatgtaggcgacgtgagccttgccgatgaacggcagcagatggtgctcgcacagcgagtagagctcgatgtccttgaccagcaccatctcgctgttatcggagctgaacaaggcaccgttggtgacttcttccagcgtttgttcataaccgcggcagaggtactgcatggctttggcggcacgttttggcgtgtcgagcaggccctcgcgggagacgtcttcgcccaattggccgaggatcgccgtgtaattctgttccagggacatgaaactacctgtgggattttacgcaaagggcaagggtacggtggcggaccgggcgctgcaagcgcgacgaagcggctttactcgtcgcggccttccatcatggtgcgtttgagcatcacgtagaccgccccggcaccgccatgtttggcctggcacgaggtgaagccgagcacctggggatgctggcgcagccaggtgttgacgtggctcttgatcattggccgcttgccgtccaggcgcacggccttgccgtgggtgacgcgcacgcagcggatttcgaacttggtggcttcggcgaggaatgcccagagggtttcccgggccttttccacgttcatgccgtgcaggtcgaggctgccctcgaaagggatctggccgaccttgagcttgcgcatctggctttcctgaaccccgtcgcgagcccacatcagctcgtcttccgggccgacgtcgatcacgaactgatcggacagcccgtcgacggtcgtggtttcggtgcgcacgctggcagcctggcgcagcttggcgatctgcgcccggtcagccttgggtttgccggtttcggcgcgatcgtgcttgatcggcctgacgccttggatcgcgcttttgaacagggaaaaatcgtcgtcttgcatgtcagcctccgcgaagaccgagcagtttacccaactcgacgggagaggggcgggacaaaacgtgttgccgtcgattcagtcatgtttcttcatcaggtggggagccatgttcagggtctgcggctggcgcatgcgccgccggcagcgacgccacagccagacgccgacatacagcagtaacagaccgaccgctagaatcaccgcggaacccgccggacttgcattcaattcgcccagcgccggagggcgccccaacaggctggcggccccggccatcgccagcagcacaccgaaggtcgccagcaacgcggagaatcccgcgcccaggcgcaaacgccagttccgcgggcctttgggccgcagacgacgtgcgtcaaaaccatcggatatcttcattccgaccttcctcaatgggtatcggcccttcgaccgaaagatgaccgggtggttcctgaggctaaggcaattacggcaaatgagaggcttttacggatgagcggccttgcccctgaaggcgcgccgctcattgcaggtcgatcagatcagatctttggtcagggcgagggtggcgaagttgtccgccatgatggccatttcggtctgctgcacgtgctcggcgctgaggatgccacccttgtagggcaggtcgcgagtggcgcaggcgtcttccaccagggtgcaacgaaagcccaggttcttcgccgcgcgcacggtggtgctgacactggagtggctcatgaaaccgcagacgatcaggtccagggagcccaggtcctgcaggcgcttttccagttcggtgccatggaaggcgctcggcagcagcttgccgatgatggtctcgtcgccctggggttcgaggccggggatgaactcaccgcgctcgccctggggatcgaacaggccgccgacggtgccgaggtggcgcacgtgcacaaccgggcggccgacggagcgggcggcagcgaccagttgcttgatgttggcgaccgcagcgtccatgccggacagggccaggggaccgctgaggtactctttctgggcgtcgatgatcacaagggtcgcgtggctcaaattagccgctgcataaccacgaccgctgagttgaaacatcgtctttggaacggacattctggggctcctgtgagtggggcttttgcgacattgtcctctggcggagcgcttctgtgaatcgctactaacgtaaggtgcgtggttgctggcctacagccgtgtcaagggctatggagaatcgggtcgaatgcggggaaaagcgcccgaacgccccgtagactcagatttttcatgcgtcgtcctcagacgttttggctgttagaatcgccagtcgttttttcaggagtctgtcccgtgatcacttcccgcctgcgcaccctgcgcgaccacatccgttgggctgtcagccgctttcatggggaggatctgtttttcggccatgggaccgacaacgcctgggacgaagcccgccaattggtactgggtgccttgcacctgccgtgggaaatcgccgacagctatctggactgcgcactggaagacgacgaactggtcaacctgcagcgcctgctcaagcgtcgcatcgaagagcgcgtaccgaccgcctacctgctgggcgaggcctggttctgcggcctgtcgttcattgtcgatgagcgggtgctgatcccgcgttcgccgatcggcgagctgatcgaaaaacgtttcgagccctggctgggcgccgagcccgcgcgcattctcgacctgtgcaccggttccggctgcatcggcattgcctgcgcctacgagttccgccatgccgaagtggtgctggccgacctgtcgttcgaagccctcgaggtggcgaaccagaacatcgagcgccatggtgtcgatgagcgggtgttcacggtgcagggcgacggtttcgacggcttgccgggccagcgtttcgacctgatcgtgtcgaacccgccgtatgtggatgccgaggatttcgccgacatgcccgaggagtaccagcatgaaccagagctgggcctggcctgtggcgacgatggcttgaacctggtgcggcgcatgctggccgaggcggcggatcatctgaccgagaagggcctgttgatcgtcgaggtcggcaacagccaggtccatgtcgaagccctgtacccggaagtcgatttcgcctggctggacttcgcgcgcggcggtcatggcgtgttcatgctcaccgccgagcagtgccgacagcaccaggcactgttcagctcccgggtctgagcaaccagcgaagcaccacaaaaaagcccgccaatcggcgggctttttgttgtcagcggtgggtcgcgatccagatcagcaacccggcctggaacaccgcaaacgccaccaggcaggtgatggtaaagcgcagcccggtgtcttcgcgcttgtacttggcgaccttttcttcgtgcttgcgcagcttcacttcctgttcttcgaggttctgctcggcctgctgcagcatctgcgcggcttcgaggatctcgacgaattgcagcttttcggtgttccagttgggcagcagttcaccgacctgcacatgcttgacgctgcccttgagatgctgggcatcggcgtaaaccacatcgaaaccctggacccgcaggaaatgatcgcgccgcaggcgcgtggcctcgttcagcgcatccttgttcgccagttcgaaaccgtccacgcggtagtgcggccatttcttctgggcccagcttgccccctgcgccagcagaaagcggccgatgccgcggttcgccggttcgatctgcaggttttccggctcgaagcgcacccgacgagtcgtgtggtcgacccagacatccaggtgattctgttccttgcgcacccgttggcccggcagttggagagtcatgcgcaacaggctgtgttccttgttgctgcgctcggcataaccgaactcgataaagcgcaggggccgtccacccgtggcgcgatcggtttgcagcggggccaggcgaagcatccggtgatgctcggcatggacgtccgcccacggcaacgccacggcttcgggagcggggttttcaacctcggtttcgggagggttctgggtatcggtcataacggcgagatcctgtccaagcgctacttgccgacggcaagtgaacggccggcaaaggcttatcggccgtttttttcaggactggaggggaaaacgcgtcaacgggcgtgaagtccgtcaataaagctgatgatgcgggtgccgagttccgaggccaggggcagttgcggatccttgtaggaggccagttgccgcttgacgtcgttgggcacgatacgcaggacatggttcatgccttcgatcagcgccagtttggcgtccggtttggcggccttgagcatctgcgcatcgccgacaccgacctggatgtcattactgccctggacgatcagcgccggcattttcaggcgggcgaacgcggcggccgggtcttgcctgaacagggtgatcaggtacggctgcacgctggggcggaagatcacttccagttgcggcggcacgtcagtgtcgacccggccggccttgaggctgtcgagcagttcgttgctgcgcagcatcagcggcgctggcaggcggtagctcagttgctggcgcagcacctggtccaccgggcgagcggtgccggagatggagatcaccgccgccgcatcgacctggggcgcggccagggtggcgatcagcgcgccttcgctgtggccgagcatgatcaacgggcccaggcgcgggtcgctcttgagcttcttgccccaggccacggcgtcggcgacgtaggcgtcgagggtcaggttacgctcatccggggtggcggcgaggctggcggccaccccgcgcttgtcgtagcgcacgctggcgatgttgtgcttggccagcacccaggccaggcgcttgaggctgtcgttgcgcccgccgtcggggttgttgccgttgcggtcggtggggccggagccggagacgatcaggaccaccggcaccggggcgtcggacttgggcagcagcagcgagccgtataactcgccagtgccggtgtcgaggctgatgggacgttgcagtacggccgcctggaccaggccggtgaacagggtaaggctcaagagaagaactcgcagcatcatcacgccatcatggagaaggtgccggttggacttccggacacggataaggttcgaggatgaactagttggggagcctgcgtatacttcccggctcagtaatccagattgagttatttcggctgatttcatggagcgtcctgcatgtccggcaatacctacggcaagctgttcactgtcaccaccgcgggcgaaagccatggtccggcgttggtcgccattgtcgacggctgcccaccgggtcttgagctgtcgttggacgatctgcagcgcgacctggaccggcgcaagcccggcaccagccgccacacgacccagcgccaggaagccgatgaagtcgaaatcctctccggcgtgttcgagggcaagaccaccggctgctccatcggcctgctgatccgcaacaccgaccagaagtccaaggactactcggcgatcaaggacctgttccgcccggcccacgccgattacacctaccaccacaaatacggcattcgcgactaccgcggcggcggtcgcagctcggcgcgggaaaccgccatgcgcgtggcggcgggggccatcgccaagaagtacctggccagccagggcatcgtggtgcgtggctacatgagccagctgggcccgatcgaaatcccgttcaagacctgggactcggtggaggaaaacgccttcttcagccccgacccggacaaggtgccggagctggaagcctacatggaccagctgcgtcgcgatcaggactcggtgggcgccaagatcaccgtggtcgccgagggcgtgatgccgggcctgggcgagccgatcttcgaccgcctggacgccgagctggcccatgcgctgatgagcatcaacgcggtcaagggcgtggaaatcggcgccggtttcgccagcgtcgcccagcgtggcaccgagcatcgcgacgagctgaccccacaaggcttcctcagcaacaacgccggcggcatcctgggcgggatttcctccggccagccgatcgtcgcgcacctggcgctcaagccgacctccagcatcaccaccccgggccgctcgatcgacatcgatggcaacccggtggacgtcatcaccaagggccgtcacgacccgtgtgtgggcatccgcgccacgccgatcgccgaagccatgatggccatcgtgctgatggatcacctgctgcgtcatcgtggccagaatgccgacgtgcgcgtcagcacgccggtgctgggccagttgtaatggcgtctctgccagtcgccacggtctgacggccgtggcggcgctcccgtactggcggctctccagtttctacctgttctatttcgccttgctggggtcgaccgcgccgtttctggcgctgtatttcgatcacctggggttttccagcgcgcgtattggcgagctggtggcgattcccatgctgatgcgctgcgtggcgccgaacctctggggctggctgggcgactacaccggccggcgcctggccatcgtgcgttttggcgcgatctgcacgctgctgagtttttcgctgattttcgtcagcaagagctacgcctggctggcgatggtcatggccctgcatgcgttcttctggcacgcggtattgccgcaattcgaagtgatcaccctggcgcacctgcaaggccagaccgctcgctacagccagatccgcctgtggggctcgatcggtttcatcctcacggtggtggcgctggggcgattgttcgagtggttgagcctggacatctacccggcggcgctggtgctgatcatggccggcatcgtgctcagcagcgcctgggtgcccaacgcccagccagtggcacagggcagccgcttggccgccgggggctttcttggccagctgcgcagccccggcgtcctggccttctatgcctgcgtggcgctgatgcaaatgagccacggtccttactacaccttcctgaccctgcacctggaacacctgggctacagccgcggcttgatcggcctgttgtgggcgctgggggtggtcgccgaagtcttgatgttcctggcgatgagctggattctctcgcggttttcggtacgccgggtgctgctggcgagtttcctgctggcggccctgcgctggttgctgctgggcgcctttgccgaacacctgtgggtgttgttgtttgcccaggtgctgcatgccgcgaccttcggcagctttcatgccgcggccattcatttcgtgcaacgcagcttcggcgaccgccagcaaggccagggtcaggccctgtacgcggccctggccggcaccggcggcgcattgggcgcgctgtattccggctacagctggaacgccctgggcgcgacattgacctttagtattgcaagcctcgcagcgctggcggcagccgttatcattgccacacgtatgcaagaggagaggccatgagccttacccgcgaacagctggcacaggacatcatcgaggtcggacgctttctgtatgcccgcggctggtccccggccaccagcagcaactattccacgcgcctgtcgccgagcgcgctattgctcacggtttcgggcaagcacaaaggccagttgggcctggatgacgtgctggccaccgacttgtcgggcaacagcctggagccgggcaaaaaaccgtcggccgaaacccagctgcacacccagttgtacagctggaacccgcagatcggcgccgtgttgcatacccactcggtgaatgccacggtgctgtcacgcctgaccgccgaggacttcatcgagttcgagggttacgagctgcaaaaggcctttgccggcattgccagccacgagtcgcgggtgcgcgtgccgattttcgacaacgatcaggacatcgcccggctggcgaccaggatccagccctggctcgacgcccatgccgattgcgtcggctacctgattcgcggtcatggcctctacacctggggcgcgcgcatgagtgacgcgcagcgccagatcgaggccttcgagtttctgttcgagtgcgagttgcagactcgcgccctgttaaaccgttaaggcttgcttcgactgaagtagccagcgcctgatgatatgcactgcctgaccggcctggaaaaatccgcaaggcactgccgataacgaggaattgccaagatgagcagcctgtccgtttaccacgtatccagcccggacctgccgaacaaggtgctgacccatttcgacgatatcgccgcgaccctggccgagcagggcgtgcgcttcgatcgctggcaagccgccaccaggatccagccgggcgccagccaggaagaagtgataggcgcctatcaggaacagatcgaccgcctgatgaccgagcgcggctacatcaccgtcgatgtgatcagcctcaatggcgatcacccgcagaaggccgagctgcgcgccaagttcctcgacgaacatcggcatgccgaggacgaggtgcgctttttcgttgccggtcgcggcctgttcagcctgcatatcggcgactacgtgtatgccgtgctctgcgagaagaacgacctgctttcggtgccggccggtaccgcgcactggttcgacatgggcgagaccccatacctggtggcgatccgcatgttcaacaacccgcaaggctgggtcgccaacttcaccggttccgatatcgccagccagttcccgcttctggaggattgagcggatgccgatcaaggccattctcactgacatcgaaggcaccaccagcgcggtgagttttgtcttcgaggtgctgttcccctacgcggcgcggcacctgccggacttcgtgcgcaagcacgccagccgagccgacgttgccgagcagttgcaggcggtgcgcgaggccagcggcgagccggcggcggacgtcgagcgggtgatcgagatcctcctgggctggatcgcggaggatcgcaaggccacgccactcaaggccttgcaaggcatggtctgggagcaggggtatagggccgggcagctcaagggccatgtctacccggatgcggcggcggtgttgcagcgctggcaccaggctggctatcggctgtacgtctattcgtcgggttcgatccaggcgcagaagctgattttcggttgctcaactgccggggacctggcaccgctgttcagcggttttttcgacaccacctcggggccgaaacgggaagtgcagtcttaccagcgcattacccaggccatcggctgtgcgcccgggcagattctctttctgtccgatatcgtccaggaactggatgcagcccggtccgccggcctggccacctgcggcctggtgcgcgaaggcgggatattggcggggcatgcgaatgtagcgagcttcgccgatatcgatccgcagggtttctgaaaagcaatcaggccgtgtcagcgcaaggctggcacggcctgattggggttatctgttatctaactgccggtgatcaccgcgaatccgcagcggtgcggatttaaagcgagtgatacgacggcagggcaaaacggttctggctttgcagcagggaaatctgtggcaattcgctggcctgttcggccaggtcgcgacgcaacgcgctgatcacccacgacaactgatcgcccgcatgcaactgcgcataggagatcgagcgcttgagctgtttaccttcgctgttacgcagcgtcagcaggatgccgccatcgggccgtggctgagtggtcacttcgtagttggagaacagggaagcgaatttttcttggatcaggctcatgtctatcagctccattggttcttgaatggcaaacctgaagtgataggtgcagcgattgtgccagcctcaattttttataaaaatcgttataaatcatattgttataaaaatacgtcatttgcgtgtccgtgcaatttgcatgaatggccatcgtgcatcctgcattttgcgagatcgcagacctggcaagggctgcggcgtaacgctgtgactgccggttcacgcaaaagattcaatcggcacgcccggccctcaagcgcgaggcacctggcggcgcggaggagatacaaaactttgcaaaaactccatgtacaggccaagaagcgctgacgtatttttttgccagcgacaggcttggcgcagactctttgctcaagccaaaaccctgatgttccgggctgtacaggtcaatcagacgtttcaccgacatggacagtcatgcgccgtgatctcttggatcatgggcgcctgataataagaaaataggacgtcatcatgaacgccacgctctgcgttactgccaatagcacgcccgctgtttctcccctgtttgccgtggcggcccgccctcggcccccagctgaatagccccatcgacccttgtccgcctgcccggcctggccccgtgcaggatccttttgcgtcgaacaggagccgtcatgagcactcatcagcacgacatgatcacctggggcatgatgctacggaagttgccctccatcgcccgggcgttgccgcgggtcatcaagggcatgcagatagccaacgtcaagcgcgccgatcaaccctgcggactgggctggaccttcgagcaggccacccaacgcaaccccgacggcccggcgctgctgtacggcgaccgggtgttgagttatgcacaggccaaccagtgggccaaccggatcgcccattacctggcgagccagggcatcggcaagggcgacgtggtggcgatcttcgtcgagaaccgtcccgagttgctggtgagcgtgctggcggtggccaagctcggcggcatctgcgccatgctcaataccgcgcagaccggcagtgtgctggtgcacagcgtgaacctggtgaagccggtggcgatgatcgtcggcggcgaactgctggatgcctactcggcgattcgcgatcaagtcgccatcgacgaggcgcgcacctggttcgtcgccgatccggaggtggcgcccgggccaacgcctgtcggttgcatcgacctgatgaccgccagcgccgccagcgaatcgtccaaccccccaagtaccgcgcggatctacctcgacgatccgtgcttctatatctacacctccggcaccaccgggctgcccaaggccggcattttcaagcacggccgctggatgcgtacctcggccagcttcggcatgatcgccctcgacatgcagccggccgatatcctgtactgcaccttgccgctgtatcacgccaccgggttgtgcgtgtgctggggctcggccatcagcggcgcctcgggcttcgccattcgccgcaagttcagcgccagccgtttctgggaagacgcccgccggttcaaggccaccaccattggttacgtgggcgagctgtgccgttacctggttgaccagcctgccagcgagcacgaccgtgacaaccgcgtggtgaagatggtcggcaacggcctgcgtcccggcgtgtgggggccgttcaagcagcgtttcggcgtcgagcatatctgtgagctgtatgccgccagcgacggcaatatcggctttaccaacgtgctcaacttcgacaataccgtgggtttttccctggcgccctgggcgctggtggagtatgcccacgacacctgcgcgccgatccgcaacggttccggcttcatgcagaaagtcgccaggggcgggcagggcctgctgctggcgaagatcgacgacaaggcgccgctggacggctataccgagccggaaaagaacctgaaggtgatcctcaccgacgtgttcgagaagggcgaccgttacttcaataccggcgacctgctgcgcgatatcggttttggccatgcgcagttcatcgatcgcctgggcgatacctatcgctggaagggcgaaaacgtctccaccaccgaggtggagaacatcctcctgcgccatccgcaggtcgccgaggcagtggcctatggcgtggaggtgcacaacaccaacggtcgtgccgggatggcggcgatcactccggccgaatccctggcgaccctggatttcaccgagctgttgcagttcgcccgcgagcatctgccgggctacgcggtgccgctgttcctgcgggtcaaggtgaagatggagaccaccggcaccttcaagtaccagaagacccggctcaaggaagaagccttcgacccgtcgaaaaccggcggcgatccggtgtacgcctggttgccagggtcggcgacctatgtccgggtgacggaggcggtcctggcggatattggtgccggtcggcaccgctattgattctggctatggccgctcttgagaaaaaagggatgacagggcaggagccgcttggggacactagcggctttccgattggccgaaagtggagttcccgatgtcagacaaaagccgccagatgaccgcagaagaagccgccgagttcaccgagcaggtcttcaacgtcgcccgtcaaggcgacgcccagatgctcgacaagctggcgagcagcggtctgccggtcaacctgcgcaatcacaagggcgacaccctgctgatgctggccagctactacgggcatgtggacgcggtgcaggtgctgctcaagcacaaggccgaccccgagatccgtaacgacaacggccagagcccgatcgccggcgcggccttcaagggcgacctggcagtggtcaaggcgctggtggaaggcggtgccgaggtggagggttcgtccttcgacgggcgtaccgcgctgatgatggcggcgatgttcaaccgcacggaaatcgttgactaccttatcggcaagggcgccaacccgcgggccaccgatgccaatggcgtgagcgcactggacgcggcgaagaccatgggcgccgtcgacaccaccgcgcaattgcagaagttgctgggctgagctgaacggcgcataccgtcgggcctgggccatgcctgggtcgcggcggtaggttcgcggggcgggtttaggctatcctgcgcgcccgccattgacccgtaacaggattcgcccatgaaaaacgtcctcgccgaactcatcactaaaatcagctccggctgcatgggcgaagaagaaatcctgcggatcgccgacgaggccgcccaggcctacgccgatccccaggccttcctggccgccaatccggacatcaactacgacgacagcttcccgatcccgctgggcgaatgggtggtggtcggcagcctgccggacaccgtgctgttccaggccgacacctacatggacctgttcgcgcagatcgtcgcgtctttcggcccgggcgtggcgttcaatatcaagcccaagcaactggccaagaccgaggccctgacagcgctcaaccgcatccagatccagatgggcagcatgaacccggaaaacggcggttacgtgctgatgaacttcagccagttgctggacgacgagctgcaagtggtgctggtctacggcaacgacgtgccgcgggtgctggagctgtgcgccgaagccggcattgccgccgcgccgtccctggaagcgctcaaggtcgcggttcacgtctgagccgcgggccacaggccgaccgcgcaggcaataaaaaggaaccccgctgccggccgactatcctaagtgggcaagccctcatttaggagcgacaccatgggttccactttcaatacgctggttggactgatcatcctcgcgctggacatctgggcgatcatcaatgtgcttaaaagcagtgccgaaaccgggatgaaaatcctctgggtgttgctgatcatcctgttgccggtgctgggcctgatcatctgggcgattgccgggccgcgcggcaacgtacggctctgaaggctggcgtggggttcaaaaggggccgccaggcccttttttatgtgaccaaatatgcgctgcacgaaattttcacaaagtctccatgacaattcgccagcgctgtttttccgctgctcccgtgcgatctccgattgcgatcccaggctctggaccattgccagccaggggagggcgcctgccagtaatcaatggcaatgccgctgctgatcgtgcaacatttgcgcaccgcgccatccccccagccctgaatggctacaagagggcaaagcgcagctgcattcttttcgcaacttcaacttccattgggtcctaaaacgatatggcaaacccggacgtcctgagtcagcagcgagcttcgagtcgcctgctgcaaccgaccgtcaaatcgcatctggcttatacgctgctctgcgcgctggccatgatggtcatgctgtctttgctgcgcgtggcgctgctggtctacaaccgcgagatgatcctcgacacaccggcctcgaccttccttgaagccttcgccaacggcctgcgcttcgacgtgcgcctggtggtctacctcagcatcccgctgctgctggcgctgttcagtgcccgggccatggcggctcgcggtttcttccgcttctggctgaccatcgtttcgagcatcgcgctgttcctcggcctgatggagatggacttctaccgcgagttccaccagcgcctcaacggcctggtcttccagtatgtgaaggaagacccgaaaaccgtgatgagcatgctctggtacggcttcccggtggtgcgctacctgctggcctgggcgctcggcacctggctgctgagcctggcgttcaagggcgccgaccgcgcgacccggccgcgtggcccgttcagcggcggcagcatcggcacccgacaggtcgccccgtggtacgcccgtatcggcgtcttcgtggtctgcctgctggtctgcgtggtcgccgcccgcggcaccctgcgccagggcccgccactgcgctggggtgacgtctacaccaccgaatcgaacttcgccaaccagctgggcctcaacggcacgctgtcgctggtcgaggcggccaagagccggatgggcgaggaccgcagcaatatctggaaagccaccctgccgcagcccgaggcgcagcaagtggtgcgcgacctgctggtgatgccggacgacaagctggtggacgccgatatcgccgccgtacgccgtgactacacgccaccggccgacaagaccctgccgatcaagaacgtggtcgtgatcctgatggaaagcatggccggtcactcggtgggtgccctgggcgctccaggcaatatcaccccgtacctggaccaactgtccaaggaaggcctgctgttcgaccgcttcttctccaacggcacccatacccaccagggtatgttcgccaccatggcctgcttccccaacttgccgggtttcgaatacctgatgcagaccccggaaggcagccacaagctgtccggcctgccgcaggtgctgagcgcccgcaagtatgacgacgtgtatgtctacaacggcgatttcgcctgggacaaccagtcgggcttcttcagcaaccagggcatgaccaacttcgtcggtcgcaacgacttcgtcgatccggtgttttccgatccgacctggggcgtgtccgaccaggacatgttcaaccgtggcctggaagagttgaaggcgcgggaaaacggcaagccgttctatgcgctgctgcagaccctgtccaaccacaccccgtacgctttgccgacgccgttgccggtggcgaaggtgaccgaccgtggcagcctgaacgaacacctgaccgccatgcgttattccgactgggccctgggccagttcttcgagaaggcgcgcaaggagccgtacttcaaggagacgctgttcgtgatcgtgggtgaccatggtttcggcaacgagcgccagatcaccgaaatggacctgggccgcttcaacgtgccgatgctgatgatcgctccgggcatccaggaaaaattcggtcagcgcaaccacaccgtgggcacccaggtcgatatcgtgccgaccatcatgggccgcctcggtggcgaagtgcgtcaccagtgctggggccgcgacctgctcaacctgccggaaggcgacaccggctttggcgtgatcaagccgtcgggcagcgaacagaccaccgccatcgtcaccgccgaccagatcctggtactgccgcgcgaaaaggaaatgccgccgaagatctaccagtacgaactgggcgccaatccgcatgccgaagtggtgccggacgcaccgcgtaccgccgagttgaagcacaagctggaagctttcctgcaaaccgccaccaagagcctgttggataacaccgcgggcgtggtgcacggcacgccggactgattcattgcgctaatgaaaaagaggccctagggcctcttttttttcgacggttgaacagtaccgagtgtgaacgaccgatgcctatatccggcccagtaacacgagaatcagcaacaccaccaggaccacaccgatgatcccggacgggccataaccccagcttctggagtgcgggaacactggaagaccaccgatcagcagaagaatcagaataatgatcaggattgtgcccatgtcgttttccttattggaggatcgaaggcgcggctggattcgaaggcaattaatccgtaccgcttaatcattcggactctgtgccttgaaggatgattccaagtttttttaatgctttttgcacgcaggcctatttcttttcgtaccggctgccggtggccatcgagttgaacttgcaacaccgcgggaagtcgcaccgaggccccggtttgcctggggcattcagcaatctgatggtgcgtgggcggcacaaaatccttcgctacactcgcctcatctttcccggaacaacaaggcaactcctatgcaaaatcgcatgatgatcactggcgccggatccggcctgggtcgcgaaatcgctctgcgctgggcgcgcgaaggctggcagttggcgttgtcggatgtcagcgaacccggcctgcaggaaaccctcaggctcgtgcgcgaagccggcggcgatggcttcgtgcaacgttgcgacgtgcgtgactatagccagttgacggccttcgcccaggcttgcgaagtcaagctcggcggcatcgatgtgatcgtcaataacgccggcgtggcctccggcggctttttcagcgagttgtccctggaggactgggactggcagatcgcgatcaacctgatgggcgtggtcaagggctgcaaggcgttcctgccgctgctggaaaagagcaagggccggatcatcaatatcgcctcgatggcggccttgatgcagggcccggcgatgagcaactacaacgtggccaaggccggcgtggtggccctgtccgaaagcctgctgatcgaactggcccagcaggaaatcggcgtgcacgtggtatgcccgtcgttcttccagaccaacctgctggattcgttccgcggcccgactccggcgatgaaagcccaggtcggcaagctgctggaaagctcgccgatcagcgcggcggacatcgccgactacatctacacccgggtcgccgccggcgaattcatgatcctgccccacgaacaggggcgcatggcctgggccctgaagcagaagaacccgcagctgctgtatgacgaaatgaccctcatggccgacaagatgcgcgccaagaccaagcaaaatgccagctgagcttgctcctgccccggcgcgtcgttagggttgccagcatctggcatccctgacgagaccttgcatgctcaattacctgtggttcttcctcgccgcgctgttcgagatcgccggctgctacgccttctggatgtggctgcgccagggcaaaagcgcctggtgggtagtcccggcgctggcgagcctgatgctcttcgccctgttgctgaccaagatcgaggcgagctacgccggccgcgcctatgcggcgtacggcgggatctacatcatcgcctcgatcggctggctgggtatggtggagcgggtgcggccgctgagttcggactggctgggggtggcgctgtgcgtgatcggcgcgagcatcatcctgttcggaccgcgctttaccaacggttgagaaactggccgggttgcgggcgccgcgatggcgcccggtcccggccgggaatcagtcgaacaattccttgggcacatcgtgcttgagcatcaactggcactgctcgctgtccgggtcgaagacgatcaccgcctggcccttggtcagcgcctggcgcacgcgcaggacccgggtttccagcggggtgtcgtcgccattgtcggtgccgtcgcgggtgacgaagtcttcgatcaggcgggtcagggtgtcgacttctagttggtcatggggaatcagcatacgggcctccggcaaacaatcccggatcctactgcgccgggccccgcgcggctaggcaaacctcgcgcggggccgtaatgccgatcatctgtaggagcgagcttgctcgcgatgagcgcgcagcgctcgccttgagggccctgcgtatttacctgtgagtacgtgtggggcgagagttcagcgctttgcgctctatcgcgagcaagctcgctcctacagtggaagcggggcttttcacctcagggcttttgccccaccaggctgtccaccgacggcacccgggtgtcgctttccatttgtgtgtcgtgttccagttgatggctgaagcggtccagggaaccctgggccggctgcgcgtcgctggcgaacaccggcgggctgagaatgtaggcgcccagcaggcggctgagggccgccaggctgtcgatatgggtgcgctcgtagccgtgggtggcgtcgcaaccgaaggccagcagggcggtacggatatcgtggccggcggtgaccgccgaatgggcatcgctgaagtagtagcggaacaggtcgcggcgcaccggcagttcgtgttccgtggccaggcgcagcaggtggcgcgacaggtgatagtcgtaaggcccgccggagtcctgcatggccacgctcaccgcgtgctcgctggagtgctggccgggggcgaccggggcgatgtcgatgccgacgaactcgctgacgtcccagggcagggccgccgccgcgccgctgccggtttcttcggtgatggtgaacaacggatggcagtcgatcatcagcggctcgccgctgtcgacgatggccttgagcgcggccagcagtgcggcgactccggccttgtcgtcgaggtggcgggcgctgatatggccgctttcggtgaactccggcaagggatcgaacgcgacgaaatcgccgacgccgatgcccagcgactcgcagtcggcacgggtggtgcagtaggcatccaggcgcaattcgatgtggtcccaactaatgggcatctcgtccaccgcggtgttgaaggcgtgcccggaggccatcagcggcaacacactgccacgcaatacgccgttgtcggtgaacaggctgacccggctgccctcggcgaaacggctggaccagcagccgaccggggccagggtcaggcggccgttgtctttcaccgcacgcacgctggcgccgatggtatccaggtgcgccgaaaccgcgcggtccgggctgttcttctggcccttgagggtggcgcggatggtgccgcggcgagtcagttcgaagggaatgcccagttcttccaggcgctcggccacgtaacgcacgatggtgtcggtgaagccggtggggctgggaatggcgagcatttccaggaggactttctgcaggtagttgaggtccggttcgggaatcgatcgggtcatggaaactcctgatgatgaaaaggccatcgatggtttcgatgaacaaggcgtcgggcgctcgctcccacagtgcgtttctgtaggagcgaggcttgcccgcgataaggccgcgacggtcagcacggggctttcagaccgccggctgactgtggggaaacaacaggtcgacaaagcgctcggccgtcggctgcggttcatggttggccaggccggcgcgctcgttggcctcgatgaacacgtactgcggctggtccgccgccggcaccatcaggtcgaggccgaccatcgggatatccagcgcccgcgccgcgcggatcgccgcgtccaccagttccgggtgcagaatcgcggtgacatcttccagggtgccgccggtatgcaggttggcggtgcgccgcacgaacagccgttcgccggccgccaggatgctgtcgtagccgtgcccggtggcctgcagggtgcgctgggtttcatggtccagggggatcttgctttcgccgccagtggcggcctggcgacgccggctttgcgcttcgatcagctcaccgatggagtgctggccgtcgccgatcacctcggccggccggcgaatggccgcggcgaccacctcgaagccgatcaccaggacgcgcaggtccaggccctcgtggaagctctcgagcaacacccggctgtcgaaccgccgggcgttgtcgatggcctgttgcacttcttcgatggtgcgcagatccacggccacaccttggccttgttccccgtcgagtggcttgaccaccacccgttcatgctcgtcgagaaacgccaggttgtcgtcggcgttgcccgcgagttgttgcgccggcaggttcagcccggcctgtttcagtaccttgtgagtcaggctcttgtcctggcacaggctcatgctgatggcgctggtcaggtcgctgagggattcgcggcaacgcacccggcggccgccatggctgagggtgaacatcccggcttcggcgtcgtcgacctgcacgtcgatgccgcggcgatgggcttcctcgacgatgatccgcgcgtaagggttgaactgcgcctcgggcccggggccgaggaacagcggctggttgatgccgttcttgcgcttgatggcgaaggtcgacagggtgcggaaacccagcttggcgtacaggcacttggcctggcgattgtcgtgcagcaccgacaggtcgaggtagctcaggccacggctcatgaagtgctcgatcaggtgccggaccagcacttcgccgacccccgggcgggtgcaatgcgggtccaccgccaggcaccacaggctgctgccgtgctccggatcgtggaaggccttctggtggtccaggcccatgacgctgccgatcaccgcgccgctgtcttcgtcttcggccagccagtacaccggcccgccggcatggcgcggagtcagcaggctcgggtcgaccggcagcatgttgcgggccaggtacagctggttgatggcctgccagtccgccgcgctctgcgcccggcggatgcggaagccgcgaaacacccgggtggcctggcggtagtcgctgaaccacaggcgcagggtgtccgacgggtcgaggaacaactgggtcggttccaggccgaggatctgctggggggcggcgacatacagggcgatgtcgcgttcgccggggtgttcgttgagcagctcttcggccaggctcgtcgggtcgggaaaggtatggccgatcagcagtcggccccagccgcaatgcacggcaatcgggtcggtgccgagggcgctgcggtcttcggcgaaacgcgcctgcaggcgctcgtaggagggcgcctgaccgcgcagcaagcgttggctgtaagccgtggcatggggtttcatggtcagattccttgttcgctgagccacaggttcagcgccgccagttgccacagcttggagccgcgcaacggcgtcagctggccttgtggatcggtcagcaggcggtcgagcatcgccgggttgaacaggccgcggtcctggctcgggtcgagcagcagttcacgtacccagtccagggtggcgccctgcaggtgcttgaggccgggcaccgggaagtagcctttcttgcggtcgatcaccgcgctggggatcaccaggcgcgcggcttccttgagtacctgcttgccgccatcgggcagcttgaaccgggccggcacccgcgccgacagctccaccagccggtagtcgaggaacggcgtgcgcgcctccaggccccaggccatggtcatgttatccacacgcttgaccgggtcgtcgaccagcatcaccgtgctgtccaggcgcagggccttatccacaggctcggcggcgccgggctgggcgaaatgctcgcgcacgaaatcaccggcggcgtcgttggcggtcagccactgcggctgcacggtggccgcgtaatcgtcgtagctgcggtcgaagaacgcttcgcggtaggccgcgtagggatcgctggcgccctccacctgcgggtaccagtggtaaccggcgaacagttcgtcggcgccctggccgctctgcaccaccttgcagtgcttggcgacttcccgggacagcaggtagaaggcgatgcaatcgtggctgaccatgggttcgctcatggcgcggaacgccgccggcagctgttcgatgatctcgcgctcgtcgatgcgcaactgatggtgatcggtgccgtagtgctgggcgatcaggtccgaatactggaactcgtcgccgcgttcgccgccggcatcctggaagccgatggagaaggtcgacaggttacccacacccacttcccgcagcaggccgaccagcaggctcgagtcgacgccgccggacagcagcacgccgacatccaccgccgcccgttggcggatcgccacggcttcgcgggtgctgtcgagtacccggtcgcgccagtcttccaggctcagcccggtttcatcggcgcgcgggccgtagggcagggtccaccaggttcgctgctcggtgcggccgtcggcttcgatgcgcatccaggtggccggcggcagtttctcgatgcccgccagcagggtgcgcggcgccggcaccacggcatggaagttcaggtaatggttgagcgccaccgggtcgagcagcgggttgatgtcgccgcccttgagcagcgccggcaaggccgaggcgaaacgcaggcgctggccggtgcgcgacagatacagcggcttgacgcccaggcggtcgcgggcgatgaacaggcgcttggcgtcccgctcccagatggcgaaggcaaacatgccgttgagccgcggcagcagatcggcgccccaagcgtgatagcccttgagcagcacctcggtgtcgccgccggaataaaaggcgtagcccaggctttccagctcggcgcgcagttcggggaagttgtagatcgcgccgttgaaggccagggacaggcccagctggttgtcgatcatcggctgggccgagccgtccgacaggtccatgattttcaggcgtcgatggcccagggctatcgggccctggctatggaaaccccaggcgtcggggccgcgaggggcgaggtggtgggtaattcgttcaaccgctgccaggtcggcgggttgatgatcaaaacgtagttctccagctaatccgcacataagtccttaccggtttttccgttggggagaggtgaatcgtgacctgccagaaacggcaggtacccggaaactgacccaggtgatcccctggagttttagaccgatgggttataagcggcggggcgcaagtgcgttgccggctggggcaaaggccttgatctgcctggagttttgccgtgcgggcagggcccgtgggcgtttgcgggagatggccaagcgatgccagggcggctggcatcgcggctttatttcatggcttgccgcgaatcaaccgacgcaaggcaaagcgattggggtgacaggcttcggctacgctgcgcggcaggggcagcggttcgttgtccagccaggcggccagcaactcgcccgacagcggcgcggtgatcaagccgcgtgagccgtggccgctgttgatatacaggccgtccagccaggggcagggcaggtccggaacctggcgcgcgtccttgcccagcaccgcgtagacctcggcgaatgccgcctggtccgccaggggaccgacgatcggcagatagtccgggctggtgcaacggaaggcggcccgtccttcgagggtttgcgcttgcagccggtcggcttccaggcgttccaccaggtcccgggagatctcttcgagcatctgcaggttgcccgcatgctcggcggcggtgggtgtcaggtcttcgctcttgaaatcgaaactggcacccagggtgtgttcgcccaggcgcgcgggggcgacataaccttcggcgcacactacggtggccaggctctggctgcgcgcagtctgcggcagtcgggtgatctgcccgcggatgcgcttgagcggcagctcggcgctgggcgggaagcgcttgatctcggcggcgccggcgaggatcaccacctcggcactggccagcagccggtcgccgtcccaggcctgccactggccatcgacccggcgcaattccacgacatcgtggtggggcagcaggcgaatccgcgggtgcgcggcttgccactggcacagggccggcggatgcacccagccaccttccgggtagaacagcccgccgtgggccaggccgattccggccagggcctgggcctggggttggtccagctgatgcagcaggtccgccgggaaggctgccgccaactgcgcctggcgctcggcttccttggcgttgaaggccagttgcagcacgccgcagctgtcccagtcgacgccccgttgcagctgttcgagcaggcgccgggtgtagccgaaaccgctgaggatcatctgcgacagggcggtgccgtgggccgagagtttcaggtacagcacaccctggggattgcccgaggcctcctgggccagttgcccgtggcgctccagcaggctgacccgccagccccgcgcggcgaggctggcggcgctggcgcaaccggccaggccggcgccgatcaccagggcgtgtttgtcctggatctgttgcgtggggcgggcgaaccagggcttgctggcggcaggcagcggcgtgtcttcgggccagccgagaaactcgccgcgcagcacttcccacttgtggccgatgcccggggtgcgcttcatcttgaagcccgcggcattcagcaggcggcgcacccagccggtgctggtgaaggtgctgatgctcgaacccggcgcggccaggcgcgccagttcggcgaacagctcggcggtccacatctcggggtttttcgccggggcgaaaccgtcgaggaaccaggcgtcgacctgcccgtcgagttgtggcaattgctctagggcatcgccgactagcagggtcagggtgacccggccctcgtccagcaccaggcgctggaagccctggtgcaccgcgacataggcgcgcaacaggcgctcggccagcggccccagctccggccacagggccagggcgcgctgcaggtcggctggcgtcagcgggtacttttccacgctgacgaaatgcaggcgtgcgctggggtcggcctgttgttcgaacaactgccaggcgcagaggaaattcaggccggtgccgaagccggtttcgccgatgacgaagcggccactgggcggcaacgcggcaaaacgctcgcgcaggcggttctgttcgagaaacacatggcgggtttcgtccaggcccgactcggtggagaaatacacatcgtcgaagacccgcgaacgcgggcgaccttggtcgtcccaatcgagctgggcgtgggattggggagggggcaattcggcgctcatgttcggctcggtagcggcaaggcggccattctagccgatcgacacaccgggtaatgatccacggcaataagcggcatgttcggggccgacaaagcctaggtcgatccgctagtcttgctccatcttgccagggagtcgctcatgttcgaatcagccgaaatcggtcacgccatcgacaaaaaaacctttgacgccgaagtcccggccctgcgcgaagccctgctggaagcccagttcgagctgaagcagaaagcccgttttccggtgatcgtattgatcaacggcatcgaaggcgccggcaagggcgagacggtgaaactgctcaacgagtggatggacccacgcctgatcgaggtccgcaccttcgaccagcagaccgacgaagagctggcgcgaccgccggcctggcgctactggcggatgctcccggccaagggccgcatgggggtgtttttcggcaactggtacagccagatgctccaggggcgggttcacgagctgttcaaggacggccgtttcgaccaggccatcgccggcgccgagcgcctggaaaagatgctctgcgacgaaggtgcgctgatcttcaagttctggttccacctgtccaagaaacagatgaaggcccgcctcaagtccttgcaggacgacccgctgcacagctggcgcatcagcccgctggactggcagcagtcggagacctacgacaagttcgtcaaatacggcgagcgtgtgttgcgccgtaccagccgcgattacgcgccctggcatgtgatcgaaggcgtggacccgcattaccgcagcctggcggtgggcaagattctcctcgagggactgcagaatgccctcaaccggcccgaggtcgaagctgatccccatgtggcgccgctggccgaggcggtcgacaagctgaccctgctcgacagcctggacatgagccagcgcctggacaaggacgactacgaggagcaactgattaccgagcaggcgcgcctggccggcctgctgcgcgacaaacgcatgcgcaagcacgcgctggtggcggttttcgagggtaacgacgccgctggcaagggcggggcgattcgccgggtagcggcggcgctggacccgcgccagtaccgcatcgtgccgattgccgcgccgaccgaggacgagcgggcccagccgtatctgtggcgcttctggcggcacattccggcgcggggcaagttcaccgtgttcgaccgttcctggtacggccgggtgctggtggaacgggtcgagggcttttgcagcccggcggactggttgcgcgcctatggcgagatcaacgacttcgaggagcagctcgaggacgccggggtgatagtggtcaagttctggctggcgatcgacaagcagacccagctggagcgtttccaggcccgtgaagagattccgttcaagcgtttcaagatcaccgaggacgactggcgcaaccgcgacaaatgggacgcctaccgcgccgccgtcggcgacatggtcgaccgcaccagcaccgaggtcgcggcctggaccctggtggaggccaacgacaagcgctgggcccgggtcaaggtgctgcgcaccctcaaccgcgcactggaagaggcattcgacaagtccgagaaaaaggacaggaaaggcaagaagggcaagaaataaccgccgcgggttgggagtgggtcactggataaacccagtaacgcgatggttttgcatacgccggatgaatgattgtcgcggccgggcaagggctggatctatgctcgagccactcacaaccgacaacaacaatgaggtatgccatgcgtgaagtggtgatcgtcgatagcgtgcggaccggcctggccaagtcctttcgcggcaagttcaaccagacccgtccggatgacatggccgcccattgcgtcaatgcgctgctgagccgcaacggtatcgacccggccagcgtcgaggactgcatcgtcggcgccggttccaacgaaggggcccagggctacaacatcgggcgcaacgtcgcggtgctgtcgcgcctgggcaccggtaccgcgggcatgaccctcaaccgtttctgttcgtccggcctgcaggcgatcgccatcgccgccaaccagatcgcttccggttgcagtgacatcattgtcgccggcggggtcgagtccatcagcctgacgatgaagagcgtcaacaccgacaacctgatcaacccgctgctcaaggaacaggtgccgggcatttatttccccatgggccagaccgccgaggtggttgcccggcgttacaacgtgagccgcgaggagcaggacctgtatgccctgcaaagccagcagcggacagcgacggcccaggcggccgggctgttcgatgacgagatcgtggcgatggcagtgaagtaccgggtcgaggacaagaacagcggccaggtgcagattctcgacggcgtggtcgatcgcgacgattgcaaccgcccggataccaccctggagagcctggccggtttgaagccggtattcgccgaagacggctcggtgaccgccggcaactcctcgcaactgtccgatggcgcctccatgaccctggtcatgagcctggagcgggccctggcgctggggctcaagcccaaggcgttcttccgcggcttcaccgtggccggttgcgagccggacgaaatgggcatcggcccggtgttctcggtgcccaagctgctcaaggccaagggcctgcaagtggacgacatcgacctctgggagttgaacgaggccttcgcctcgcaatgcctgtacagccgcaaccggctgcagatcgacaacgccaggtacaacgtcaacggcggttcgatctccatcggccacccgttcggcatgaccggttcgcgccaggtcggccatctggtgcgggaactgcaacggcgcaacctgcgctacggcatcgtcaccatgtgcgtcggcggtggcatgggcgcgaccgggttgttcgaagcggtgcgctaagcccgtcaggcgggggcggatctgtctgccttacgaacctatcgcgggcaagcctcgcgcctacaggacggtggtgtttctgcaggtgcgaggcttgcccgcgatgtttttgcgacctgcacagtcctgtttacgttccccctccaactgtctctgtgtaagtcacagctccgggcctagaatgcgggctctctccatcaggcttttgggggttgcatgcacatctcgtccggtcgctgggtctacggcttgttcctcgcactgctgacggcgctgctgtggggcatcctgccgatcaagctcaagcaagtgttgctggtgatggacccggtgaccgtgacctggtttcgcctgttggtgtccggtggtttcctgctggtctacctggcggcggtcaagcgtttgcccaactggcgggtactcgggccgcgcggcggctggctggtgctgatggcggtctgcgggctggtgggcaactacgtgctgtacctgatggggctgaacctgctgagccccggcaccgcgcaactggtggtgcagatggggccgatcctgctgctgatcgccagcctgtttgtgttcaaggagcgtttcagcctggggcaggggattggcctggcggtgctgctgatcggtttcgggctgtttttcaatcagcgcctgaccgagctgctgacgtccttgagcaactacaccgccagggtgctgacggtgctcgccgcctcggcggtctggaccttctacgccctgggccagaagcagttgctgacggtgtggaattccttgcaggtgatgatggtgatctacctgttctgcgcgctgttgctcaccccgtgggcccatcctctcgaagcgcttgaattgagcccgctgcaaggctggctgttgctggcctgctgcctgaataccctgatcgcctacggtgccttcgccgaagcactggcccattgggaagcgtcgcgggtcagcgccacgctggcgatcacgcccttggtgaccttcgccgcggtggcggtggcggcctggttgtggcccgaatatgtgcatgccgaacagatcaacggcctgggctatggcggggcggtgctggtggtgctggtggtgctggtggtgctggggtcggccttgacggcgctggggccttcgctgatggccgggctcaaggcgcggcggggacgtatggaagtgccgcagagctagggcgcgttatcgtcgatcgcgggcaagcctcgctcctgcagaagcaggagcgaggctgatttgcagctgatccaatcgctggcgatcaaccctgcttgccagcctccagcatgttttccggacgcacccaggcatcgaactcttcgtccgtcaggtaacccagctccagggccgcttcacgcaaggtgcggttctcggcataggccttcttggcaatctcggcggacttgtcgtagccgatatgggtgttgagcgcagtgaccagcatcagcccgcgttccagatggtcggccatctgcaccgggtcgggctccaggccggcgatgcagtgctgctggaagttgctgcagccgtcggcgagcaggcgcaccgattgcagcaggttgtggatgatcaccggcttgaacacgttcagttgcaggtggccctggctggcggcgaagccgatggccacgtcgttgcccatcacctggcaggccagcatcgacagggcttcgcactgggtcgggttgaccttgcccggcataatcgagctgcccggttcgttggccggcagcctgacctcggccagcccggcccgtggtccggagcccagcaggcgcaggtcgttggcgattttcatcaggcacaccgccagggtcttcagggcgccggagagggtggtcaggggttcgtggccggcaagggcggcgaacttgttcggcgcggtgacaaacggcaggccggacaaggccgccagctcggcggcgatcgcctcgccgaaaccatggggcgagttcagcccggtgccgacggcggtaccgccctgggccagctcacagaccgccggcagggccgcgcgaatggcgcgctcggcgtagtccagttgggcgatgaaggccgacagctcctggccgaaggtgatgggggtggcatccatcatgtgggtgcgcccggttttcaccagcttcatgtgccgtgccgcgagttcggccaggccaccggacagttcggcgatcgagggcaacagatgctgctgcaccgcctgggccgcggcgatgtgcattgccgtggggaagcagtcgttggagctttgcgagcgattcacatggtcgttggggtgcaccggggtcttgccgccgcgcgggttgccggccagttcgttggcgcgaccggcgatcacctcgttgacgttcatgttgctctgggtgccgctgccggtctgccagaccaccagtgggaactggtcgtcatgctggccgtccagcacctcgtcggcggcctgttcgatcaggcgggcgatgtcggccggcaggtcgccgttgcggtcgttgacccgggccgcggccttcttgatcaacgccagggcatgcaggaccgacagcggcatgcgctcgttgccgatggcgaagttgatcagcgaacgctgggtctgggcgccccaataggcttcgtccgggacttcaacctggccaaggctgtcggtttcgattcgactcatcgtgctcactcctgtaggtctgattgcgcagtttaggccgtgatccagcgcctgggttccataaagcgccttttgtgtcatttggtcgagcaaatgcaggcaccacaaggcttggggttgagcgacagagttttttaggcgcagaatggtcgcccttggggttatacctcgcctgctagaaaaggaaactcgatgactcgtcttcgtgccatctgtaccgcggttgctctggtttgcgccagcggccaggtgcttgccgataccgccagccacaacgccagtgccgaagctttcctgaccctggcgcacgctgacaagctgggcactccggtgtacatgcaagtgcagcaaatgttcgctcagcgttttgaacagaccaaagccccagagtcgaaaaaagccgtgctggaaacctaccaggccaaggccaacgccgccctggaccaggccatcggctggaacaagctgaagccggacatggtcaagctctacaccagcaacttcagcgaatccgagctcaaggacctggtggcgttctaccagtcgccgctgggcaagaaagtcctggaaaaaatgccgcagctgacccagcaatcggcccagatgacccaggccaagctggaaagcgcggtaccggtagtcaacaagctgctggccgacatgaccgccgaactcgagcctaaggccgcaccggcgaagaagaagtaagcggagccaggaatgaccatgcaacaacgtatcgaatcggcactgggcgcattgcagcctgagcatttgcaggtgctggatgaaagccacatgcacagccgcggcctggaaacccacttcaaggccgtgctggtcagcgagcagtttgccgggctcaacagcgtcaagcgtcaccagaaggtctacgcgaccctgggcgagctgatgggccagtttcatgcgttggcgctgcatacctacacgccagaggaatgggcgaagatcggcgtggccccggcctcgccgacctgcgctggcggcagcaagcattaaccacaggttttttgctagaatccgcaacgcgccgctcagtcggcgcgttttttttgcatccggttcaccctttgcgagggtagccacctggagaattacccatgacacaacagattgtcgtggcggcactgtataagttcgtcaccctcgaagattacgttgccctgcgcgaaccgctgctcgaggcgatgctcgacaacggcatcaagggcaccctgctgatcgccgaagaaggcatcaacggcaccgtttccggcagccgcgaaggcatcgacgggctgctggcctggctcaagaacgacccgcgcatggtcgacatcgatcacaaggaatcgtactgcgacgagcagccgttctaccgcaccaaggtcaagctcaagaaagagatcgtgaccctgggcgtgcccggcgtcgatccgaacaagaaggtcggcacctatgtcgagccgcaggactggaacgcgctgatcagcgacccggaagtgctgctgatcgatacccgtaacgactacgaggtttcgatcggcaccttcgaaggcgccatcgacccgaagaccaccagttttcgcgaattccccgactacatcaaagccaacttcgacccgagcaagcacaagaaagtcgcgatgttctgcaccggtggcattcgttgcgagaaagcttcgagctacatgctcagcgaaggcttcggcgaggtcttccacctcaagggcggtatcctcaagtacctcgaagaggtgccgcagcaagagagtaaatggcagggcgactgcttcgtcttcgataatcgggtgaccgtgcgtcacgacctcagcgaaggcgactacgatcaatgtcatgcctgccgcacgccggtaagcgtcgaggatcgcgccagcgagcactatgtgccgggtatcagttgcccgcactgctgggacacgctgagcgagaaaacccgccgcagtgccatcgaccggcagaagcagattgaactggccaaggttcgcaacatgccgcatccgatcggttacaactacaagcaatcttcttccgaggcctgagccatgtctgcccgcctgctctatgtgatggacccgatgtgttcgtggtgctggggcttcgctccagtggccgaggccctggtcgagcaggcgcgggccgcgggcgtcgagttgcatctggtggtgggcggcctgcggaccggcagcggctcggcactggagccgaccacccgccgctatatcctcgaacactggcaggcggtcaccgaggccaccggccagccgttcaagttcgagggcgccttgcccgacggttttgtctatgacaccgagcctgcgtgccgcgccatcgtcacggcgcgcagcctggcgccggattgcgcctggaaacttttgcggctgatccagcgggctttttacgtcgaaggccgggatgtcactcgcgccagcgttctggtggaactggccgaggaagcgggcgtgccgcgcatcgagttcgccgaggcgttcgatcgcgccgagcagcatgccgcgaccgccgccgatttcacctgggtccaggacctggggatcgccggtttcccgacgatgctggccgagcgcaatggccagctggccttgttgaccaatggctaccagcccctgagtgagctgtctccactgctcggccgctggctggagcgtgccgcctgtgcgtgatccacaagcagcggaacccgtcgatcgcctgagctgggcgcaagtccgccggctggcactgcagcataaaaaagccctgtgggtcgccaatggcgtggccgtcctggcgacgctgtgcagcgtgcctatcccgttgctgctgccgctgttggtggacgaagtgctgctgggacatggcgatgccgcgctgaaggtgatgaaccatgcgttgcccgcgggctggcagagcgccgccggctacatcggcctgatgttgctgatcaccctgatgctgcgttgctcggcgctgctgttcaacgtgctgcaggcccgtttgtttgccgggctggccaaggacattgtctatcgcatccgcctgcggctgatcgagcgcctcaagcgcatttccctgggcgaatacgaaagcctgggcagcggtacggtgacgactcacctggtcaccgacctcgacaccctcgacaagtttgtcggtgaaaccctcagccgttttctggtggccatgctcacgctggtgggcaccgcgggcatcctgatgtggatgcattggcagctggcgctgctgatcctgttgttcaatcccctggtgatctacgccacggtgcagttgggcaagcgggtcaaacacctgaaaaagctcgagaacgacagcacctcgcgtttcacccaggccctgaccgaaaccctggatgcgatccaggaagtccgcgcgggcaaccgccagggctttttcctcggccgtcttggccggcgtgcccaggatgtgcgggactacgcggtggcttcgcaatggaagagcgacgcctccaatcgcgccagcgggctgctgttccagttcggtatcgatatcttccgtgcggcggccatgctcaccgtgctgttttccgatctgtccatcggccagatgctggccgtattcagctacctgtggttcatgatcggcccggtggaacaactgctgaacctgcagtacgcctactatgccgccggtggcgcgttgtcgcgtatcaacgagctgctgtcgcgggccgacgagccgcagtatgccggcggtgtcgacccgttccaggggcgcgagaccgtgggtatcgaagtcagcggcctgagtttcggctacggtgacgaactggtgctggaccagatgaacctgtcgatcgagccgggggagaaggtggcgatcgtcggcgccagcggcggcggcaaaagtaccctggtgcagctgttgctggggctctacacaccgcaggcgggcgtgattcgttttggcggcaagacccagcaggaaatcggcctggaaaccctgcgggaaaacgtggcggtggtgttgcagcatccggcgctgttcaacgacagcatccgcgccaacctgaccatgggccgcgagcgcagcgacgaagcctgttggcgggcgttggaaattgcccagctggactcgacggtccgcgccctggccaacggcctggacagtgtggtcggccgttccggcgtgcgtctgtctggcggccagcgccagcgcctggcaatcgcgcggatggtcctggccgaacccaaggtggtgatcctcgacgaagccacctccgcgctggacgccgccaccgagtacaacctgcaccaggcgctgacgcgtttcctccacggccggaccacgctgatcattgcccaccgcctgtccgcggtaaaacaggcggatcgggttctggtgttcgatggcgggcagattgccgaagatggcgaccatcagcagctaattgccgacggcggcctttacgccaagctttacgggcatttgcagcaagtccagcgaccttgagttttatccggttttctgtgcttagtgcttgaattctctggtggaaatgatcctcctgggacgcggccctgtcgcgtctcgactggcatcgtgcttgagcgtcatggcctgtgcgttcgaagcagcagaaattagcctagtctgtgctgtcaggagcgttattttctcgggtgttcatctggcagtgcttatgcaagggacctcatgaagcaaaagcggactctcggaacgccacggttattgggcatcgtctggccatttattgcggtggtgttgtttcaagcactgttgggtggcctcagcttatatgtcctttcggcggtacgtgtttacgttgccggggagagtctttggtccaagggccagaaggacgccatctactacctcaatctctacgccgacagccgcgacgaatcgatctttctgaagtaccagaatgctattgccgtgcctcagggcgggcatgagctgcgggtcgcgctggatcagcaaccgcccgacctgaatgccgcgcgggcggggattctcaaggggggcaaccaccctgacgacagcgacagcgtgatctggctgtacctgaacttccgccatttcagctacctggaaaaagccatcgacctgtggaccgtgggcgacagttatctggtgcagctcgacagcgtagcccatgaaatgcaccacagcattaccagcaaccaggcctccgaagccgatatccagcgctggaagaaccagattttcgccatcaacgatggcgtgacgcccgctgccaaggcctttagcgatgctctaggcgagggttcgcgggtcatcctgcggctgttgctgatcaccaacctggccaccgcgctggggctgattgtcctggccttgctgcgcacccataagctgctggcccagcgtcatgaattcgccagcgccctgcagttggaaaaggaacgggcgcagatcaccctgcaatccattggcgacggtgtcatcaccaccgacgtggacggcgccatcgcctacatgaacccggccgccgaggaaatgacccactggaaggctgaacaggcggtgggactgccgctggcggccttgttcaacctgctggatgaaaatgcccaggccgatggcttcaccctgatcgagcacattctcagcggtcagctcagtggtggcagcgagcactcgaagctgatccagcgcctggatggcagcacggtgtcggtgaccctggtcggcgcgccgatccagaatgccggcaaggtcagcggtacggtgctggtgctgcacgacatgacccaggagcgccagtacatcgccaacctgtcctggcaggcgacccacgacgccttgaccggcctggcgaaccgtcgcgagttcgaataccgcctggagcaggcattgcacagcctgagccggcaaccggggcggcacgccctgatgttcctcgatctggaccagttcaagctggtcaacgatacctgcggccatgcggcaggggacgagttgcttcggcatatctgcgccttgctccagtcgggcctgcgcgagggcgataccctggcgcgcctggggggcgatgagttcggcatcctgctggagaactgctcgccggaagcggcggaaaagatcgccgaaggcctgcgccagacggtgcagaacctgcattttgtctggaaaggccggcccttcgtcaccacggtcagcattggcctggtgcatgtggcgcaaaccccgaccactctcgaagcatcactgcgggcagcggacatggcgtgctatatggccaaggagaaagggcgcaaccgggtccaggtctatcacgcggacgactcggagctgtccctgcggttcggtgaaatggcctgggtacagcgcctgcacatggccctggaggaaaaccgcttctgtctttatgcccaggaaatagccgccctgggtcatgtggaccggctcggcgggcacatcgagattctgctgcgcctgcacgacgaggccgggcggatgatcctgcccgacagctttatcccggccgccgagcgttacggcctgatgacctccctggaccgttgggtggtggagaatgtgttcaagatcatcgccgaatgcatccgcgaggagcgcgaagggcccctggcgatgtgtgcgatcaatctgtcgggcgcgaccatcggtgacgaggctttcctggacttcctgcgcgagcagttcatcgtccacggtgtgccaccggatctgatttgttttgaaatcaccgagaccagcgctatctccaatctcggtagtgcgattcgatttatcaacgagctcaagggcttgggctgtcacttttcgttggatgacttttgtgcgggaatgtcgtcattcgcttatctcaaacatttgcctgtagacttcctcaagatcgatggaagttttgtaaaggatatgctggacgacccgatcaatcgcgcgatggtcgaggtgatcaaccatatcggtcatgtgatgggcaagcgtacgattgccgagtttgtcgaaacaccgcagattgagcaggcattgttggagattggcgtggattacgctcagggctacctgatcgagcgcccgcaactcttcacctgcgacagtctgcagtgccggccttcgcgaccacagcctctgttattcaaggctcctggcacgttccgttgaatctctcgctgatccgtaccatcaccatcaaaaggagccccgacagtgatcgacgcattcaacagaaccggtccgctcatggacgctgcaagctatccggcctgggcccagcagctgatccaggattgcagcgagagcaagcgccgcgtggtcgaccacgaactgtaccagcgcatgcgcgacaacaagctcagcaacaaaaccatgcgccagtacctgatcggcggctggccggttgtcgagcaattcgccctgtacatggcgcagaacctgaccaagacccgcttcgcccgtcaccccggagaagacatggcgcggcgctggctaatgcgcaatatccgggtcgagctcaatcatgccgattactgggtgaactggagccgcgcccacggtgtgagcctggaagatctgcaggcgcaacaggtcccaccggagctgcacgccctgagtcattggtgttggcacaccagctccgccgactcattgatcgtggcaatcgctgcgaccaactacgcaatcgagggtgccacgggtgagtggtcggcgctggtctgctccaccggcgcgtatgcggcggcctttcccgaagaagagcgcaagcgggcgatgaagtggctgaaaatgcatgcccagtacgacgatgcgcatccctgggaggcgctggaaatcatctgtaccctggccggcatgaagccgagcaaagccttgcagggcgagctgcgccaggcgatctgcaagagttatgactacatgtacctgttcctggagcgttgcatgcaacaggaaaagaccccggcggcccgtgagcggatggcgctggtcgaaggttgaatggcggcctccgatagaggcggccccagccattctctcagccggccatcgccaggcggttgcggccttcgcgcttggccacatacaacgcgctgtccgcacggcgcagcaggctctcagctgattcccccggcagcagggtcgagcaacccaggctgaccgtcagctcgatcaacttgccatccgcccagtaatccttggcctgggccgcctggcgcagccgttctcccaccatggcggcggcatcgcggccggtattggacagcaggatcaggaactcctcgccgccaaaacgaaacaccatgtcgacgttgcgcaactgcgccttgatggccgcggcaacagccttgagcacttcatcgccggcgctgtggccgtggctgtcgttgattctcttgaagtgatcgatatccagcatcagcagcgacagtgggtgcaggtggcggcgggccatttcgatttcccgttgcagcgtctggtccatggcgatccggttgccggtatcggtcaaagggtcgcgcagggcgctacgggtcgcggcccgatagagcagggcgttgcgcatcggataaagcagggtggatagcagggattccagatggccctgttcctggtcgctgaaacgctgattgcgccgaaataccagttcgcccatggtctcgccttcatggctcaggctgtagctgatggagtggtggccgcgctggccgaactccaggcgcaggtcgctgggcttgtgctggtaaaccagggcatccaggggcacaaggcgttgggtttcgcggaagaacaggccgagaatgcgttgcggttccaggctggtctgtaattgcaggctcagttgctggcgcaactgggcaaggctgaccgggcgttgcaggagtggtgactgctggccaaagcccaggcgttgcaatttggcgctatcgaagtcaattgcgttggtctgggtgggtattttcatatggcgtgagcccctgggcacgtaatgcagtcttactggctgggtgagagcggctcatggctgcacgtcatactgttccatcagtcccgtaggacaagcgatcacagtctaatccgctttacgggccgttataagccccgactcgatcgtcgctgagttttgccaatacactgcctatttgagggagatgagagcgaaagtcatgccattcgcttcatccgagtaaaatgcttttgaattcagcgggttggctgacagtgccaaggcttggggtaacccagggtggcatttgtctggcgatgacagggtggaagactgccaggaaaggagtgccgcgacggtattccgccgcggcctaagaacggattactgggcgtcgaatgcctggccgttgatcccggtactgtccggacccatgaggtacaggtagaccggcatgatctcctcgggggccgggttgttgcccgggttttcccctggataggcctgggcacgcatgctggtgcgggttgcgcccggattgacactgttggcgcgtaccggtgcgacaccgtcgacttcgtcggccagggtttgcatcaggccttcggtggcgaacttcgaaacgccataggcgccccagtaggcacggcccttgcggccaacgctgctggaggtgaacaccaccgaggcgtcctgggacagcttgagcagcggcagcagggtactggtcagcatgaacatggcattgacgttgacttgcatcacccgcatgaagttctcgcccgacagctgttccaacggcgtgcgcggaccaatgatcgaggcattgtgcagcaggccatcgaggtgaccgaactcggcttcgaccatggcggccagctcgtcgtactggtgcggcagggcggtttccaggttgaacggaatcaccaccggctgaggatggccggcggcttcgatctcgtcataaacctgggtcaggttggcttcggtcttgcccagcagcaatacggtggcgccgtgggcggcgaaggtcttggcggcagcggcgccgatgccgcgaccggcaccggtgaccaggatgacccgatccttgagcagttcggggcgggcggaataatcaaacataaaaacctcgggaaatcagaagcgaaagcctgggccgatcagcaactgcatagcgcctggtccaggacctggcgcagttccagcggatgatcgaccaccacatcggcgccccaatgcttgggattgtcgtccggatggatgtaaccgtaggtcacggcggcggtcctggtacctgcatcgcggcccgattcgatgtcgcgcaggtcgtcgccgacgaacagaacgctggccgggtcgaggtcgagcatcttgcacgccaggatcaacggttccggatcgggtttgctgttctttacgtgatccgggcagatcagcagggcggaacgttccgccaggcccaactgctgcatgatcggctcggcaaagcgcaccggcttgttggtgaccacgccccagagcagattggccttctctatatcggccagcagctcggccatgccgtcgaacagcttgctgtgcactgcgcagtgcttgaggtagcgctccagaaactccaggcgcagttcctcgaagcccggggattccgggtccatcgagaaggtgacggccaccatcgcccgggcgccaccggagatttcgtcacggatatgtttgtccgcgatcggcgccaggccgcggtcggcgcgcatggcctggcagatggcgatgaagtccggcgcagtgtcgagcagggtgccgtccatgtcgaaaagaactgctctgatacgcatgggcttattcctcccgcagggtctggatcatgtaattgacgtcgacgtcggcggccagcttgtagtgcttggtcagtgggttgtaagtcaggccgatgatgtccttgacggtcaggccggcgtcgcggctccaggcgcccagttcggaaggccggatgaatttcttgaagtcatgggtgccgcgcggcagcagcttcatgatgtattcggcgccgatgatggcgaacaggtaggccttcggattgcggttgatggtggagaagaacacctggccgctgggcttgaccatgcgaaagcacgcgcggatcaccgaggaggggtccggtacgtgctcaagcatctccaggcaggtgacgacatcgaactgctcgggcatttcttcggccagggcttcggcggtgatctgccggtattcgacgttcaccccggactccagttgatgcagttgtgccaccgccagcggggcctcgcccatgtcgatgccggttaccgtggcgccgcgctgggccatggcttcgctgaggatgccgccgccgcaaccgacgtcgaggactttcttgcccgccaggttgacgcgttcgtcaatccagttgacccgcagcgggttgatatcgtgcagcggtttgaattcgctctcgcggtcccaccagcgatgggcgagggcttcgaatttggcgatttcggcgtggtcgacgttactcatgggtaatcctctgaatctggaaagttctggctgtcggtctcgagccgggctcgagggttcctgctattcggtatggccgctgatgcgtcggccccaggctgtcgccgtggcgtgcagctgttgttcgtccaggcgcgtcaggcgccggtcgtcgagcaattgcttgccggcgacccaaaggtgtttcacgcaatcgcggccggtggcatatataagctgcgaaaccgggtcatagatcggttgctgcgccaggccggacagatcgaatgccaccaggtccgcggccttgccgagttccagcgagccgatctcgctctccaggcccagggcccgcgcgccgttgagggtggccatgcgcagcgcctggtgggcattcagggcggtggccgagcctgccacggccttggccagcagtgcggcggtgcggatttcgccgagcaggtccaggtcgttgttgctggcggccccgtcggtgcctaccgcaacattgacgccagcctgccacagccgttccaccgggcagaagccgctggccagtttcaggttcgactccgggcaatgaatgacattgctattggtttctaccagcaaagccaggtcgtcatcgctgatttgggtcatgtgtacggcctggaagcgcggcccgagcagtcccagtcgcgccaggcgggccaggggccgctcgccgtgccgggcgacagcctgttccacctcgaaggcggtttcatggacatgcatatgaatggaggcatcgagttcttcggcaatgatccggatcttctccaggttttcgtcgccgaccgtgtagggcgcgtgggggccgaaggtgatcttgatgcgcggatgatgcttgagatcgctgaacagctcgacgccctggcggatggcctcgtcggcgctgtgggcgcccggaattggaaagtcgaggaccggaatggcgatctgcgcccgaatgccgctgttgtgcacgcgctcgctggcaaccttcggaaagaagtacatgtcggaaaagcagctgatgccgcctttgagctgttcggcgatggccaggtcggtaccgtcgcggacgaaggcttcatcgacccatttggcttcggcgggccagatgtggttctccagccaggtcatcaatggcagatcgtcggccaagccgcggaacagggtcatcgctgcatggccgtgggcgttgatcaggccagggctgagcagcatgcccggcaactcgcggacctcggcagcctgcagcttcaaggccgcggcgcgcgggccgatgaacacgatgcggccgtcgcggatacccagaccgtgctccttgagcaccacgccggtcggttcaacaggcaccagccaggtcggcaacaggagtaggtcgagcgcaacgacagggttcggcatcgaagatcggttccagggcgtttgtggaggatggcgaagtatacccgagcgtcttcgccgggggctcgctataatcggcggcttttgttcatgagtgcggggtgagggatgcgcgatcgactgttggcggcggagaaggtgaaggccatcgattggcgggatgacgccctgtatctgctcgatcagcgtattttgcccttcgaggaaagctggattgcctacaccagcgcggctggcgtcgcgcaggccattcgcgaaatggtggtgcgtggcgcgccggcgatcggtatcagcgccgcgtatggtgtggtcctggcggcgcgcgcgcgttttgccgccggcggtgactggcaggcagcgatggagcaggacttcgcgctgctcgccgactcgcgtccgaccgcggtcaacctgttctgggcgctgaaccgcatgcgtgaacgcctggagcgcctcaagagccacgccgacccgctggcggtgctggaggcggaagccctggccattcatgaaagcgaccgcgaagccaacctgaccatggcccagttgggtgtcgacctgattcgccggcatcagggcaatgcccaggccatcctgacccactgcaataccggcgccctggcgaccggcggcttcggaacggccctgggggtgattcgcggggcctttatcgaaggtatggtcgaacgggtgtatgccaatgaaacccgtccctggctgcaaggctcgcggctgaccgcctgggagctggccaacgaaggcatcccggtgaccttgaatgccgactccgctgccgcacacatcatgaaaaccaagggcgtgacctgggtgatcgtcggcgccgaccgcattaccgccaatggcgacgtggcgaacaagatcggcacctatcagctggcagtcaatgcaatgcaccacggcgtgcgtttcatggtggtcgcgccgagttcgaccatcgacatggccctggccagtggcgaagacattccgatcgaggagcgtgatggcaaggagctgctcgaggtcggcggcaagcgggtaggggcggatgtggaggcctacaacccggtattcgacgtcaccccggcggacctgatcgacgccattgtcaccgaaaaaggcatagtcgagcgtcccgacaccgcgaaactggcccagttgatgtgccgcaagcgcttgcactgagatcattttgcaaaaggtttcgctgacggctgtcgtggggtggtcgtcagtccgggaaaaaaaccgcatttacgcgcgaaatcagcctctgagcttctctcgtctcttatcagcctgtcaccggtcaactaactatgctccatgcgcatcagggggataggtgcgtggcggcgattgtgataacatccggcggtttccaaggtggtccgaagtgaccgccttcactgcgcaaatccatggcataacttgttgatttgtcgtaagtcggtgcatggcactaggcctgcagcggcgagcttcgttcgtcccatatggatgtgacgaagtttcaccagaaaaaggaatcaggcttctcatgggcgaactggccaaagaaatcctcccggtcaatatcgaagacgagctgaaacagtcctatctcgactacgcgatgagcgtaatcgtcgggcgggcactgcctgatgcgcgcgatggcttgaagcccgtgcaccggcgtgtgctgtacgcgatgagcgagctcggtaacgactggaacaagccgtacaagaaatctgcccgtgttgtcggtgacgtgatcggtaagtatcacccgcacggtgataccgcggtgtacgacaccatcgttcgtatggcccagccattctccctgcgctacctgctggtagacggccagggtaacttcggttcggtcgacggcgacaacgcggcggccatgcgatacaccgaagtgcgcatgaccaagctggcgcacgagctgctggccgacctgcacaaggaaaccgtggactgggtgccgaactacgacggcaccgaactgatccccgcggtcatgccgaccaagatccccaacctgctggtcaacggttccagcggtattgccgtgggcatggcgaccaacattccgccgcacaacctcggcgaagtcatcgacggttgcctggccctgatcgacaacccggagctgaccgtcgatgagctgatgcagcacatcccgggcccggacttcccgaccgcggcgatcatcaacggtcgcgaaggcatcatcgaagcctaccgtaccggtcgcggacgcatttacatgcgtgcccgctcgatcattgaggacatcgacaaggtcggcggccgtcagcagatcgtcatcaccgagctgccttaccagctgaacaaggcgcgtctgatcgagaagatcgccgagctggtcaaggagaagaagctcgaaggcatcaccgagctgcgcgacgagtccgacaaggacggtatgcgcgtggtgatcgagctgcgccgtggcgaagtgccggaggtgatcctcaacaatctctacgcccagacccagttgcagagcgtgttcggtatcaacatcgttgcgctgatcgatggtcgtccgcggatcctcaacctgaaggacctgctggaagccttcgtgcgtcaccgtcgcgaagtggtgacccggcgtaccgtgttcgaactgcgcaaggcccgtgaacgtggccacattctcgaaggccaggccgttgccctgtcgaacatcgacccggtcatcgccctgatcaaggcctcgccgaccccgtcggaagccaaggaagcgctgatcagcacgccttgggaatccagcgcggtgatgaccatggtcgagcgtgccggcgcggattcctgccgtccggagaacctcgatccgcaatacggtctgcgcgacggcaagtacttcctgtcgccagagcaggcacaagccattctggaattgcgtctgcaccgcctgaccggcctcgagcatgaaaaactgctggccgagtaccaggagatcctcaatcagatcggcgagctgatccgcatcctcaacagcgccacgcgcctgatggaagtgatccgcgaagagctggaagtgattcgcgccgagtacggcgatgtgcgtcgcaccgagatcctcgatgcccgtctcgacctgaccctgggcgacatgattccggaagaggagcgcgtcgtgaccatttcccacggcggctatgccaagacccagccgctggctgcgtaccaggcccagcgtcgtggcggcaaaggcaagtcggcaaccggcgtcaaggatgaggactacatcgctcacctgctggtggccaacagtcacaccacgctgttgctgttctccagcaagggtaaggtctactggctgaaaacctacgaaatccccgaggcttcccgtgccgcccgcggtcgtccgctggtcaacctgctgccgctggatgacggtgagtacatcaccaccatgctgccggtcgaggaatacaccgagggtcactacatcttcatggcgaccgccaacggcaccgtgaagaagaccccgctggaatccttcagccgtcagcgcagcgtcggtctgatcgcgctggaactggacgagggcgatgtgctgatttccgccgcgatcaccgatggcgagcgcgaagtcatgctgttctccgatggcggcaaggtgactcgcttcaaggagtccgacgttcgtgccatgggccgtactgcccgtggtgtgcgcggcatgcgtctgccggaagggcagaagctgatctccatgctgatcccggaagaaggcagccagatcctcaccgcttcggcgcggggttatggcaagcgcacggcgatcaccgagttccctgagtacaagcgtggcggtcaaggcgttatcgccatggtcagcaacgagcgtaacggccgtctggtcggcgcggtccaggtgctcgacggcgaggaaatcatgctgatttccgaccagggcaccctggtgcgcacccgggtcgatgaagtgtccagcctgggccgtaacacccagggcgtgaccttgatcaagctggccagcgacgaaacgctggtaggcctggaacgggttcaggagccgtccgaagtcgaaggtgacgaattggaagacgaggatggcgaggtgctcgagggcgtcgtgctggatgcggcgaccgactcggatgatgccgtcgaaggccagcaggctgacgccgcaggcgaagaagagtcgcaagactaaataaatcgtagcagggcagagtgtttgctctgtccgctaccgtgaatgcatagcgagagtggatgtgagcaaacgagcctataacttctgcgcaggtcccgctgcgctacctgaagctgtcctgttgcgtgcccaggccgaattgctggattggcatggcaagggcctgtcggtcatggagatgagccatcgcagcgatgagttcgtctccattgccaccaaggccgagcaggatctgcgtgatctgctgaatatcccctcgaactataaagtgctgtttctgcaaggcggcgccagccagcaatttgctcagatccctctgaacctgttgccggaaaatggcacggccgactatatcgacaccggtatctggtcgcagaaagccattgaagaagcctcgcgctacggccatgtcaatgtggctgccaccgccaagccttacgattacttcgccatccctggccagaacgaatggcagctgtcgaaagacgcggcctacgtgcactacgcgccgaacgaaaccatcggcggcctggaattccagtggatcccggaaaccggcgacgttccgctggtggccgacatgtcttccgacatcctctcgcgccctgtggatatctcccgtttcggcatgatctatgccggcgcgcagaaaaacatcggcccgagcggcatcctggtcaatatcgttcgcgaggacctgctgggtcgcgcgcgcgcattgtgcccgaccatgctcgactacaaggtcgcggcggataacggctcgatgtacaacactccgccgactctggcctggtacctgtccggcctggtgttcgagtggctcaaggagcagggtggggtggaagccatcgccaagctcaatgacgtcaaacagcgcaccctgtacgacttcatcgacgccagcggcctgtacagcaacccgatcaacaagtcggaccgttcgtggatgaacgtgccgttccgcctggccgatgaccgtctggacaagccgttcctggtcggcgccgacgcgcgtggcctgctgaacctcaaggggcaccgttcggtaggcggcatgcgcgcctccatttacaacgccgtcgacatcaatgcggtcaacgcgctggtggcctacatggcagagttcgagaaggaacacggctaatgtctgagcaagaactcaaggcacttcgcctgcgcatcgacgctctggacgagaaagtcctggagctgatcagtgagcgcgcgcgctgcgcccaggaagtcgcgcgagtaaagatggcctcgctggccgaaggcgaagtgccggtgttctatcgtcctgagcgtgaagctcaggtgctcaagcgggtgatggagcgcaatcaggggccgttgggcaacgaagagatggcgcggctgttccgtgaaatcatgtcgtcctgcctggcgctcgagcagccgctgaaagtggcttacctcggtccggaaggcaccttcacccaggccgcggccatgaagcacttcggtcacgcggtgatcagcaggccaatggcggcgatcgacgaagtgttccgggaggtggcggcgggagcggtgaactttggcgtggtgcctgtggaaaactccaccgagggtgcggtcaaccacaccctcgacagtttcctggagcacgacatggtgatctgcggcgaggttgagctgcgtatccaccatcatctgctggtcggtgaaaacaccaagaccgacagcatcagccgcatctactcccatgcccagtccctggcgcagtgccgcaagtggctggatgcccattatccgaatgtcgagcgggtggcggtttccagcaacgccgaggcggccaagcgggtcaagggcgagtggaactcggcggccatcgccggcgatatggcagcgagcctgtatggcttgacccgtctggccgagaaaatcgaggatcgcccggacaactccacgcgcttcctgatgatcggcaaccaggaagtgccgccgaccggcgacgacaagacctcgatcatcgtttccatgagcaacaagcccggcgctctgcatgagctgctggtgcctttccatgacaacggtatcgatctgacgcgtatcgaaacccggccgtcgcgcagcggcaagtggacctatgtgttctttatcgacttcgtcggccaccaccgcgatccattgatcaagggtgtgctggaaaagatcagtcaggaagcagtggcactcaaggtgctgggttcctacccgaaagcggttctctgaggctttaacaatgagtggcgacttcctcgctctggctcagccaggcgtgcaacaactttcgccttacgttccgggcaagcccgtggacgaactggcacgcgagctggatatcgatccggcgaaaatcgtcaagctggcgagtaacgaaaacccgctgggcgccagtcccaaggcgctggcggcgattcgcgaagagctggccgagctgacccgctatccggatggcaatggttttgcgctcaagaccctgctggccgagcgttgtggcgtcgagctggcgcaggtcaccctgggcaatggttccaacgacatcctggagctggtcacccgcgcctatctggcgcctggcctgaatgcggtgttcagcgaacacgcctttgcggtctatccgatcgttacccaggccgtgggtgccgaagctcgagtgattccggccaaggactggggccatgacttgccggccatgctgcaggctatcgatgccgatacccgagtggtctttatcgccaacccgaacaatccgaccggcacctggttcagcgccgaggcgctggacgatttcctccaggacgtaccggcgcatgtgctggtggtgctggacgaggcttacatcgaatacgccgaaggcagcgacctgccggatggcctggatttcctggccgcctatccgaacctgctggtttcgcgaaccttctccaaggcctacggcctggctgcgttgcgcgtgggttatggcttgtcgactccgaccgttgccgatgtgctcaatcgcgttcgccagcccttcaacgtcaatagcctggccctggcggcggcgtgtgcggcgctggaggataccgaatacctggccgagagccgtcgcttgaacgaggcgggcatgcagcagctggaggccggcttccgggagctgggcctgagctggatcgcttccaggggcaacttcatcgcggtggatgtcgggcgggttgccgcgccggtgttccagggtttgttgcgtgaaggggtgatcgtgcgtccggtggccaactacggcatgccgaatcatctgcgcgtgaccattggtctgccggctgaaaacacccgtttcctcgaggctttggccaaggttctggctcgtggttgatgtcattccagtgcaacctgcggtgcctatgatcggtcgcctggtggtggtcggtctgggactgatcggcggttcctttgccaagggcctgcgtgaaagtggcgtatgtcgcgaagtggtcggtgtcgatctcgatccgcaatcgcgcaagctggccgttgagttgggcgtggtggaccgctgtgaagaagacctggcgctggcgtgccagggcgctgacgtgatccagctggcggtgccgattctggccatggaaaaactgctggcgattctggctggcatggatctggggcgggcgatcctgaccgatgttggcagcgccaagggcaatgtggtgcgggcggcgaccgaggcctttggtggcatgccgccgcgcttcgtcccggggcatccgatcgccggttccgaacagagcggggtggaagccgccaatggccagttgttccgtcgccacaaagtgatcctgacgccgctggatcagaccgacccggcagcgctggcggtggtcgataaactctggcgggaactgggggcggatgtcgagcatatgcaggtcgagcgccacgatgaggtgctggccgcgaccagtcatctgccgcacttgctggcgtttggtctggtcgattcgttggccaagcgcagtgaaaatctggacatcttccgctacgctgcgggcggtttccgtgatttcacgagaatcgccggtagtgatccggtcatgtggcacgacatcttcctcgccaatcgcgaagctgtcctgcgcacactcgatacatttcgcaatgacctcgacgccttgcgcgacgcggtcgatgcaggggatgggcaccagttgttgggcgtattcactcgcgcccgggttgctcgcgagcatttcagtaaaatcctggcccgtcgggcctatgtggacgctatgaactccaataacctgattttcctggcaaatcctggtggccgcctgactgggcggattcgtgtaccaggcgacaagtcgatttctcaccgttcgatcatgctcggctccctggctgaaggtactaccgaagtcgaaggcttcctcgagggcgaggacgccctggcgacgctgcaggctttccgtgacatgggtgtggtgatcgaaggtccgcaccatggtcgcgtgaccatccatggcgtcggcctgcatggcttgaagccggctccgggtccgatctacctgggcaactccggcacctcgatgcgtctgctgtccggtctgctggccgcgcagagtttcgatagtgtgctgacaggcgacgcgtcgctatccaagcgtccgatgaatcgcgtagccaatccgctgcgcgagatgggagcggtcattgaaaccgcagcggaagggcgtccgccgatgaccatccgtggtggccacaagctcaaggggctgacttacaccatgccaatggccagtgcccaggttaagtcttgcctgctgttggctggcctgtacgccgaaggcaagaccactgtgactgagcctgcgccaacccgcgatcacaccgagcgcatgctgcgcggtttcggttacccggtagcggtcgacggcgccacggcctcggtcgagtccggcggcaagctgcaggcgacccatatcgaagtgcctgcggatatctcctcggcggccttcttcctggtggctgcgtccatcgccgaaggttccgagctggtgctcgagcatgttggtatcaacccgactcgcaccggggtaatcgatatcctgcgcctgatgggggctgatatcagcctggaaaaccagcgtgaggtcggcggcgagcctgtggcggacctgcgggttcgcgcggcgaagctcaaggggatcgagattccggaagagctggtcccgctggcgatcgacgaattcccggtgctgttcgttgccgcagcctgcgccgaagggcgtaccgtgctgcgtggcgccgaagagctgcgggtcaaggagtccgaccgcattcaggtgatggccgatggtttgctggccctgggcgtcaagtgcgagccgacgccggacggtatcatcatcgatggcagccagattggcggcggcgaagtgcacgggcatggcgatcaccgtatcgccatggctttcagcgtggcttcattgcgtgccaatgcgccaatccgcatccatgactgcgccaacgttgccacgtccttcccgaacttccttgcgctatgtgcacaagtcggcattcgtgttgcgcaagaggcccagtcgtgaacatcaaggcgccagtcatcaccatcgacgggccaagcggctcgggcaagggcaccattgccgggattctggccaagcgcctgggctggtgcctgctggattccggtgccttgtaccgcttgctggcttttgccgcgcgcaatcatggtgtcgacctgaccaatgaggagtcgctgaagctgctggcggctcatctggatgtgcaattcgtcggagcgaccgaaggtcatccgcaacgcatcattctggaaggtgatgatgtcaccgacgatttgcgcaacgagcaggtcggtgcctgggcctcccaggttgcggcgctgccggccgtgcgcgatgcgctgttgcagcgtcagcgggcttttcaggagccgccgggactggtggctgatgggcgcgacatggggacagtggtatttcccgatgcgcctctgaagatattcctcaccgcaagtgccgaggagcgcgcgcgccgtcgctacttgcagttgaagggaaaagtcgatggtgttagtctgtcgagtctgctagatgagattcgtgcgcgcgatgagcgcgacacccagcgagcagtcgccccgctcaaaccggcggttgacgctatacagctggattccacggagttgtccatcgagcaggtgctggaacgcatcttgagcgaaatcgctattcgcgatatcaccgggtgaccaaggaggagcgcaggggaccagtcatagtcctgcggtccttcttttatatgaacgtaacccacattgtctgggatgtggcagatgggcgtattcttcgcccttatcaacaggaattaaaatgagcgaaagctttgcggaactctttgaagaaagcctaaaaaccctgaaccttcaggcaggctccatcatcaccggtgttatcgtcgacatcgactaccaagcgcgttgggtaaccgttcacgctggtctgaagtctgaagcgctgatcccgcttgagcagttctacaacgatgctggcgaactgtccatcaatgttggtgatgaagttcacgttgctctggactcggttgaagacggctttggcgaaaccaagctgtcccgtgaaaaagccaagcgcgctgaatgctggatcgttctggaagcagccttcgcagccgaagaagtggtcaagggcgttatcaacggtaaggttaaaggcggcttcactgtcgacgttaacggcatccgtgcgttcctgccaggttctctggttgacgtccgtccagtgcgcgacactacgcacctggaaggcaaagagctcgagtttaaagtcatcaaactcgaccagaagcgcaacaacgttgtcgtttcccgccgtagcgtcctcgaagccgagaactccgctgagcgtgaagctctgctggaatccctgcaggaaggtcagcaagtcaaaggtatcgtcaaaaacctcaccgattacggcgcattcgtcgatctgggtggcgtcgatggcctgctgcacattaccgacatggcttggaagcgcatcaagcatccttccgaaatcgtcaacgttggcgacgagatcgatgtcaaggttctgaagtacgatcgcgagcgcaatcgtgtttccctgggcctgaagcagttgggcgaagatccatgggttgctatcaaagcccgttacccagaaagcactcgcgttaccgctcgtgtaaccaacctgaccgactacggctgcttcgctgagctggaagaaggcgttgaaggtctggtgcacgtttcggaaatggactggaccaacaagaacatccatccttcgaaagtcgtacaagtcggcgacgaagtggaagttatggttctggacatcgacgaagagcgtcgtcgtatctccctgggcatcaagcagtgcaaatctaacccatgggaagatttctctggccagttcaacaagggcgataaaatctccggcaccatcaagtcgatcaccgatttcggtatcttcattggtctggacggtggcatcgacggtctggttcacctgtccgacatctcctggaacgaagtgggcgaagaagccgtacgccgcttcaagaagggcgacgagctggacaccgttatcctgtcggttgacccggagcgtgagcgcatctccctgggtatcaagcaactggaaagcgatccgttctccgagtacgttcaagagaacgacaagggtgcaatcgttaagggtgttgtgaaagaagttgacgccaaaggcgccatcatcaccctggccaacgatatcgaagcgactctgaaagcctccgaaatcagccgtgatcgcatcgaagatgctcgtaacgtcctgaaagaaggcgaagaagttgaagccaagatcatcagcgttgaccgtaagagccgtgtaatccagctctcgatcaagtcgaaagacgttgaagacgagaaagaagctatccagagcctgcgcgacaagccagctgcttcggatatcgctgctggtcctaccactctgggcgacctgctgcgtgcacagatggaaaagcagaactaagttctgtcagaccatagaaaagggcgacttcggtcgcccttttttgtgcctgcgatttgggttctggcttgcatctgtcaaggaagggaaaccaatagagtcgggtgtctattttcttaagcggatcaataacctattcagggctaggcttatttgagctgagtgatggtgggcgattgtccgtataaggaagtagatgaaaaatctcatcgtgattttcgtggttctagttttggtgggctgtacgaccaatgccaaggttcatgcgatccgtggtgtcagcggtatcgagatcgactgctccggtcttgggggtggatggggcaagtgctacaagcgtgccgagcgtgaatgcaagggggatggctataaggtcatcaccaggtccagtgatgccaaggacgaggagggtgactatccctttggctggaatcctgcgggttacctcactcggaccatgcttgtcatatgccgctagtaggatggcgtggtgggaggtcaaattgctgcggagtttttgttttaggcgctgttgaatgccttcgtttatggtgttttcgcaagggggaagataagtcaatgcttgggctgttcaaaatcgcccggccgtgctaaaacctttaaagcgcttatctagctgcttgaaaaagaagggaaaaatatgacgaagtcggagttgatcgaacgaattgtcacccatcaagggctgctctcatccaaggatgtggagctggccatcaagaccatgcttgagcaaatgtcccagtgcctggcaaccggagatcgcattgagattcggggctttggtagcttctccctgcactatcgtgcaccgcgggtaggtcgcaatccgaagacaggccagtctgtcagtttggatggtaaattcgttccgcatttcaaaccgggcaaagagcttcgggatcgggtgaatgaggaagaggaggaggtgtgatgtttttagcgggagggatcatatgcgtactttgaggcgtgtgctgctcgcgattgttttttttgcttttgccttgtcgattctcatttttgtgttggagaaccaggaggctgttgtattgagctttctggggcgctctatttctgcatttcctgtttctatctacattatattttcattgttggttggtatgatttttggtccattgttgagggctgtgctcaagggtgggcaaaaaaaatagtagttgcctgtagtgcggctatggtgccaaaaactgtctagcatgaggggattttcttgggtgtctggtatggggttgttggtgcatttttgagtcggggtgtttaattaaaaggttgatttgcatgcagggcgacttgatggtgagcaagaaagatgaagaggtggatctgcaggagcttgttcgggttctttggggtaaaaaggcttggatactgatttttacgttactatcggtgctatttgccgccgcctttgcctttttgagtaaacctgagtatgaagccaaaggatatgtggtgcctccaactcagaaagatatagaaaattttaactatggtagaactaaggattctcagttaaccccttatactattaaagatgtatatggtgtatttatttcctattttcaggctgagtcgctccggcaagatttttttaacaacgtctatctgccttctttgagtgaggaggagcgccaaggggcgcaagatggattgtattcaggcttttccaaaaggttgagcattactctgccaggcaaggattttcctgatcgttattccattactgtgcgcagtgaaagtcctgctcaatctgtagagtgggttcaccaatatgtagctcgtgccagtgatctggcaaagcaggagctattggccaacgtaaggcgtgaggctgaggtgggggcgcgaaacgtcgagcagcagattgcagcattgcgtaatgttagccagaaagagcgggaggactctattgttaggcttcaggaggcgttacaagttgcagaagcattggggcttgaaaagccgttgatcataacaggaaactcggccatcgaggttgctggtaatatagcgggtcaacctgtttatatgcgcggggccaaggctttgaaggctgagattgaaaatatggagttgcgtaaatccgatgacccctttattagtcgtttgcgtgagttgcaaggtaagtatgacttttataaaggggttgaggtcaaagttggagatgtgtctgtctatcgaatggatggcggtattgctcgatatgacacgccggtaaagccggtgaaatccatgattcttgcattggggttgctgattggcttggtcgggagtagcgggctggtgcttgttgtttatttgatagctagaggtcggtctgctgtatcctcctgagaaagattgtttcagctttggcgcgtgtgggtcactgagttggctgtgttttcgactgtgatgtctgtgttcagcggctactgaggctgcctcaggttttttgcttgacgggcttgacgtttctttggtgtgagttcggttcatgcatcgatgctgccttgcggaaaggcttccagtggctatcggctcaggcgttttcttcttttacgggcaggtcggtagtgatttgcccggttcgaggcctcactttggcgcttctagcaccataaaaaacttggcttggcgcccagaattgctcggtcagttcaggcataatggtcattatgaagctggaggatggcttggctgacggttgctcgcttcaaattccgtgttgaatgcatttgtggcgctattaggtaatcggtagtggctaaatagtagccgctgggcgctttctgtcggtatctgcgaaaagctctgcttgtgaggcatcgttcactgggcgtatccgaataatgtattatgcccggtgatatgtctgcgattggtgcggaatcgtcccatcttatgtggttcgataggtcaggcaatgatgtggcggtaataaagcttcaggctgaactgctgaataaataatgatatggaatcattggtaatctaatgactttaaagatcttgagtgttttcgggacgcggccggaagccataaaaatggcgccactggctttggcattgcgtgcggatgagcgttttgacgcaaaaatctgtgtcacgggtcagcatcgcgaaatgctcgatcaagtgctggagttattcgagcttgagccggacttcgatctaaatatcatgaagccaggccaagatcttaccgatgtaactacatgtattctacagggaatgaagggcgtatttgccacttataagccggatataattctggtgcatggtgatacagcaactactttcgcaacaaccctcgcagcttattatcatcagatccctgtagcgcatatcgaggcagggctgcgtacaggcaatctttattcgccgtggccggaagaggctaatcggaagttgacaggggttttggcgcgccttcacttcgcgcctacccaaaaatccgaacagaatttgttgcaggaaggggtgtctccggagtcggtttatgtaactggcaatactgttattgatgccttgctcaatgttgttgaaaagctcggatctaacactaggctgaatcagcagttttcggagcagttcaagtttctttcaacagaacggcgcttgattcttgtgacggggcatcgccgcgaaagctttggtgacgggtttgaaagaatctgtatgtcgctggcttctattgctcgtgagtttgatgatgttgaaattgtttatcctgtgcacttgaatcctaatgtgcgcgaacctgttaatcgtttactgtctggtatcgataatattcatctcatcgaaccattggattatcttcctttcgtctatttgatgaaccgttcctacttgattctgacggactccggtggtgtgcaggaggaagctccgtccctgggtaagccagtgctagttatgcgtgatactactgagcgcccggaggccgtcgaagccggtaccgtcagattggtcggaactgagaaggaaaagattaccagcaatctacgcgagcttttgcttgatagcgatgcttatcaggaaatgagctttgctcataatccttatggtgatggtaatgcctgtgcccggattattaatactcttgccacttttaaaaagtaaggtttcgttatgagcttttccactatttccgtgattggcctagggtatatcggcttacccactgctgcagtgtttgcttcgcgaaagataaaagttattggtgttgatgttaaccagaaagccgtagataccatcaactgtgggcagatccatatcgtagagcctgatcttgatatcgtagttcatgctgccgtaaccgaagggtatttgcgtgcaagcactcgtgcagaacctgcagatgcttttttgattgcggtacctactcccttcaagggtgatcatgctccagatctttcttatatcgagtctgcaagcaagtcgattgcgcctgttctaaaaaagggtgacctggttattctcgaatccacttcgcctgtaggggcaaccgagcagatggcgcagtggctggccgaggtgcgtccggacctgaccttccctcagactcatggcgaggcatcggatattcgagttgctcattgcccggaacgcgtattgcctggccatgtgctgcgtgagttggtgcaaaatgatcgggttattggtggtatgacacctaagtgttctgaggtcgctacccgtctttacaagctgtttgtagaaggtgagtgcattcttaccaatgcgcgcacagcggaaatgtgcaagttgaccgagaatagctttcgtgatgtcaatatcgcgtttgccaatgagctttctatgatctgcgataagttcggtgtagatgtgtgggaactcatcaagctggctaaccgacatcctcgagtcaatatcctgcagccaggtcccggcgtgggggggcattgtattgccgtcgacccctggttcatcgtcagtcaggccgaagggcaggcgaaactgatcaaaactgcccgtgaggtcaatgattccaaaccatcttgggttgttgaaaaagttgatgccgcggtggctgagcatctttcgcgcaatcctggaaagcccgagaaggatgttgttattgcctgttttggtctggcattcaagcctgatatcgatgacctgcgagaaagtccatcgttggaaattaccaagcacattgcgggctctcactctggtaaagtcctagcagtcgaacccaatatcgagtctttgccggcagccttggcattgcctggtgtggaactgtgtgcgatagaagaggccttcagtcgggcggatgttcttttgcttctggtggatcacaaacagtttaaggcagtcccgtcgtcggctctggaggggcgtcagatagttgatactcgcgggatctggtttgtatgaagattcttccggtaatcatgtccggaggcgccgggacgcgcctgtggcctcttagcagaacgctctaccctaagcagttcctggctatatcaggtcgtgaaaccttgtttcagcaagccatcggtaggttgatagggatagctgcgccaggctcggatttgctgccaccttgtatcgtcgccaatgatgagcaccgtttcctgtgtctggaccagattcgggagatgaaactgagcaagagttccatcattctcgagcctataggacgtaatacggcacccgcactcacactggctgctctctatgcgcgggatgagctgtcacaagtcgacccagttctggtcgtggcgcctgctgatcaaatgattctcgatgtgcagatgttcactcagtcaatcagcaaggctgttgaagttgcagcggacggcgatattgtcatattgggtataaaacctgatcgccctgaaacaggctatggctatattcattcgacagatgccgctgaagttaaacgagtcgacgcctttgttgaaaaaccagggctgcaaactacccagaagtatctggatgaaggtagttacttctggaacagtggtattttcgttctgcgagcatccgtatggttgaaggcgcttgaaattttcagggaagatattttcctggctactgagaaagcttgggccgagagaactcaggataatggatttattcggcctcaggccgatgccttctctcttgtcccgtcggaatcaatagattacgcggtgattgagcattgtgcgaaacaccctgagttgcaactcaagatgctggcgatggatgcaggctggtctgatcttggggcatgggatgctgtttggcgctcaagcgagaaggatgatcgccacaatgcaactcatggtgacgtgattgtcgaatccagcgccaatacgctggtttacgcttctcaccgtctggtgaccgctgttggtctcgacaatatcgtgatcgtcgagacgcctgatgctgttttggttgccaacaaggagcgcagtcagggcgtgaaggcgattgtcgaagcattgaatgtctgctcgcggagtgagaccaaactgcatcgtcgcgttcaccggccttggggttggtacgacagcattgattccggctcgcgctttcaagtgaagcggatattggtcaagccaaaggcaacgctgagcttgcagaaacattatcatcgcgcagagcactggattgtggtttctggtacagcagaagttacctgtgaggatcgggtttttcagttgaacgaaaaccagagtacttatattcctgttgggcatgttcatcgtctttccaatccgggcacgatacctcttgaaatcatcgaggttcagtccggaagttacttgggtgaggatgatattgttcgatttgatgatacttacggtcgtgtataagatttaaataggggctgtacaaatgcggaagaatgcgctggttaccggggttactggtcaggatggggcttaccttgttgagttgctattatcaaaaggttatgaggtatacggagcatatcggcgtacaagttctgtaaacttctggcggatggaagagttaggtgtcctgaaccatgatcgcctgcatcttgtcgagtttgacttgaccgatctggctgggactattcgtttgattgaaaactgcaaaccggatgaggtgtataacctcgcagcccaaagttttgttggtgtttcttttgatcagcctatcactacggctcagattactggtgttggtgcgcttaatttgcttgaagcaattcggatcgtgaaccccaagatacgttattatcaggcatcgacttctgagatgtttggattggttcaagctgttccccaatccgaaagtaccccgttttatcctcggagcccttatggagtggcgaagttgttcgctcattggactacgataaactatcgggagtcttatggtatcttcgctaccagcggtattttgtttaatcatgaatccccactgagaggtaaagaattcgttactcgaaaaattaccgacgcggtagctaatattgaaataggtactcagcaagttctggaactcggcaatatggatgccaagcgtgattggggttttgccaaagagtacgtagatggcatgcaccgcatgttgcagatcgatactccggaaacttttgtactggctacaaatcgcactgaaaccgttcgtgactttgtctccatgagtttcaaggctgtcggtgttgatattgactggcgtgaaagtggggagagcgagtttggtgtcgaccgtaggacaggtgtgactcgagtcaaagttaacccgcgtttctaccgacctgcagaagtggaattgttgatcggtgatccctctttcgccaaggagcgcctgggctggaagcctgaaacgacgctggagcaactttgccaattgatggtagaagcggacttgagaagggctcgtaatggcgtctcacactaatgaccgcaggatcttgatcacgggcctctccggttttaccgggaggcacctggccgagactctgtcccaggctggctggcaggttgctggcctgggagggcagcgactaccttgtgagtttgatcacttggaagctgaccttaatgagactgatcggttgtgcgattggatcaagcaggttcaaccgactcatgccatccacttggctgccttggcacatgtgacgagcagtgatgcgctgtcctactaccgagtcaatgtactgggtacggaaagtctgcttaccgctatcatcgagtcgaaaatagacatcgaaaaggtggtaattgccagtagcgccaatatctacggcaacgcgctttcgtcacctatcgtggagtctgtccagccacagccgatgaaccattatgctctgagcaagttcgccatggaggcactgctccgtaagtggtttgttcgcttgcctatattggtgacgcggccttttaactacacggggccaggccaatcggagtcctttgtgttttccaagatcgtcggtgcttttgccagaggtgaaaaggaaatcaggctggggaatctggacgtttctcgcgatctttccgatgtgagatatgtggttgaggcctatgcgcgccttttgacatgcgaaaagcatagtgagtttgtcaacatctgttcggggcggagtatttccttgctcagcgtgattgacgaaatggtacagattgctgggtatcggcctaatatagtagtggacccggctttcgtccggagcgatgaagtaaaagaactttatggaagttcggccaaacttttcgatactgtgggggtgttagaggtgcctagtttgcatgagacacttctctccatgtatcagcaaaagataagtgtccaaggttaatggctatagcgggttggtgaactgtgcgtatatgtttttttgcgaatatgtcagctcacgccaattggcgtgagttgtttgataaagttgagttttatagagtcgatattcggattcttaaagaactcgggcatgaggttgtgctatccgggacgccagggactctggattggaaggctgatctttatttttgctggtggtgggggcattcaccttttcctttgctcgcgggaaaacttcgccgccgaccggttgtggtaaccggggcttttgactactccacctgccgaaaagaaattccagggctctgttatctggatcggccatggtggcagaagcttgtgctacgtagctctttgttattggccgatagaaatctgtttatctcgaagtccgagtgtgaagaggttacttccaaccttccggtaaaaaatccagtctatgccacattggcaatcgatacagaattctactcaccgggcgaatctccgtctgctgagtcggattacttttttaccgttacttggacaagccggactaatgctattcgtaaaggtctcattcctactattgaggcatttgcagaagttgcgaaaaaagcgagcaagcttcggttggtggtagctggtaagcatggtgactatctggatgagctgaaaagccttgcgcatagattgggtgttgcagacaaggtcgagtttgttgggatgatttccgacgaagagaagcttgaacattaccgtaaatgtcttgcttatgttcagcctaccctctacgaggggtttggccatgcaataggcgaggctttggcctgtggggcgcgagtaatcacctcgccaagaggtgcggtacctgaggtcgctggggagtttgcttactgggtccagccggacagccagaaagagattaccgcagccatggaaatggtagtggctacacctattgcggagggagaagcgcaggctaggcatcaatggatttcctctaactattcgatcgcatctcgccgggctgcattgaaaagtgttctggattcactattgccagaaagaaagggtaacttcattgataataattaataatactaatggtggtactgcgtgctagcccgtttgatcagtattttcgagagttcgaggctattacagctgtttgttatcaccgcttgtatccaaggtggcgttatcatcagccagtttttgattacgccttgggtcgacccttcagttgtaggggttgtccgttctctggagacagtcatagcgctcgttgtattggctggcagtttggggatgcaaagtatcgctatccgcgatacagcggcctatagtgatgcatcctgtcaaagcgcggtgcttcggcaggtttttttacttgtctcgttagcgtctggtgtcgttatttttggtatatatatcgttcatgagtttgtgttgacttctgtaataagctcctatgtatttacagcttgtggcttagttgtgctgactaattttcttcgtgtcagtacaggttttgcccaaggcgcgaaggcgataggggagatttatcttgtactaatgctggttaccgccgcgggcgttgtgctgcacgttatactcaccaaactttacggggtgcggggatggatggcagctcgttatctgggggagcttttctgtctgatagctgtctggtggaggctcagagcttatattctgccggccctgaattttgccgcagtagataagaagcaattgatgattactgccaagtccggtgtaactattaatgccagtttgtttgttcgtctattggttgatagcttgccggttctgatgctgactgcccttcatgtcagaaccgaagagatcggtttttttggaatcgcggtactaagcttggttctcggattgttacctttggctatcattgcccagcgagcgttacccgatctggtcgaggcgctcggccatcctgatgagctccgcaaaaagtactcttctgctttgaaaagcatgttgaaagtatcttctgctgtggcgttgctgctgattctcatatcatcagcctggtggctttttatcggtggagcctataaaaccactgctctctatgtgatggtcttggcgttaacgttgccgttgaaagcaattgctctcgcgtgcggcacaatgttggtggcgcttcgtgtatttggattgagcctcaaggtcaatatcttggaaggtttacttgtactgattcttctctatgtgggaattccgattctggaaggatgggctggggttatggcttattcggctggcgcagtgctatcagcagtgctcctactctctgcggtaaaaatccgcttagctgttttataattatcagagagaggctggtcatgtcgaggaaaagctggtttatgccttcagcaagaaagggaagttttgattgttttagcgtgggttttttcttttttgtgatttggtttgcaggggttatcgttccgctgtatccgtttattatgagttttgacggtttcagtcagatttggaattttagcttttctgataaaagtttagctatccggagcgctctgattttatatacagcggcgctcttttttgtgctgctcggctgttatttgggacgtaggcttcagctgaatatgcctgcggcggttcgttgtattgtgagtgcgaaagtattttttttcggtcttttgtatttacggtaattgctctgttggctcttgtcataattctgattgcgctaggagggctgtcagggctgattcaaggtgctagtgatcgaatcaggacgtttgctggtttgaatggtttctttcttttgcagaacttgctcctttctgtttcgttggcgtggtttattcgcttaacacgaggggagaagaaggggctctccgaacgggttatcttttggttgtattttttggttgggatttttgtttgcgggttgcaggggcagaaatcgactatttttattatcgtgctttcattgattgtcgtcaggcattaccgggttcagcgcgttagtctgataaaaggggctgtgcttggttttgtgatgtttgtttccttgatggcttaccacctattcaaacaagagtttttggtgtcggggaagttttcgtttatcaatgatgaacagggtgtgtttttatcctttgttaacttcttggccatacagtttacagggaatctcatgcagttacagacgatgagtgtactggttgatgccatgccgcgacttcttgactggcaaaacggcacgacattgttaatgatcgttttgattttaattccatccggaatctttcctaataagcccatgactgctgctggagtgtttacaggcgctttctggccgaacatgtggttgagggaaggtacgacattgccacctggaatatttggcgagctttacatgaactttggaactcttggtgttctactaggaggcttgctgcttggggtcctatggggatggctctacggtgctaccatcaacaaccctaaaagcgaccgagcattgggtgtatatgcgctgaccgttgcttccatgcttcatttgttcagaggggaattggcttcggtggctcttctcgttgcctctattctgatcccctttttattattaagctcaaagcgccaagaacctgttaataattcgatctagagactcttatgtgcggaattctgggctacatacataacgggacgcgagagtccattgatttctcttcggcactttctttcattcgacgtcgtggtccggatgacaaggggatctgggctgacactgatgtgggcgtatggttgggacaggtccgcctgtctatcctcgatacgacgtctgccggacaccaacccatggtttcggcagacggccgtgtggtcatggtcttcaacggtgaaatctataacttccgcgaactgagagcccatctggaggcggcgggagatgttttctccagccagtccgactccgaggtgttgcttgcattgttttgtcgttatggcattgagtgcttgaatcggctgaacggtatttttgccgttgtgttctgggagcgggacacgaatacgctctgggtggcgcgcgatcaacttggtgtaaaacctctttatatccattccggtgatggctgctttgctttttctagtgaaatgaaagggctcattcgcagtggttttggtaccaccgaaatcgatccgcgggctgtgctggctcatctcggcttcttatggtcgccgggagagaaaacaatcgtccgggatatcaagaaggttcttccagggcaggcactgtgcgttcgtaatggacgtattgaaaagagctggttttactacgagttgcctattgcggaaaagaaactggcgaagaaagtcgatgatgttgctatcgaggtggctgacgcggttaggaccgcagtcaagcgacagctggtttcggacgtcccgctgggctcttttctgtccggagggttggactccagtgcgatagtcgcctttgctgcacaggagatgcagaacaagggacgactgcagtgtttcagtatccgtatcgataatggcgccacgtcaaatgaagggtttgctgacgatcttccttatgcgcagaaagttgccaagcacctggatgtggatctgcatgtggtcggcgttggcgatgaaatgatggaccgactgcctgagatggtttatctgctggatgaaccaactccggacccggctgccctgaatgccttgtttatctctgaattggcgagccagaacggtatcaaggtgctgctgtccggtgcgggcggagacgatatcttcaccggttatcgtcggcatttcgccttggcccaggagcggtggtggggcgggttgcctaaaccgcttcggtcggtgcttgccaatgcctccaatctgctccctgcgtcgtcgccactgtcccggcgtctcgggaaggcttttcgttatgcggatcttccaagcgacgatcgcctgatcagttatttcctttggttggagcccgagcaggcttacggcctattggcaccggatctgcgtcgccagttggcggcggacgatctgtttgcgccgatgcgtgagacactttcgcgtttgccttccgacgtgactccgctggacaagatgctcaccctggagtgcaagcacttcctcacggatcacaacctcaattacaccgacaagatggggatggccgcgggcgttgaagtgcgtgtgccattgctcgacctggatctggtgcgcttggcgggttcgttgccttccgacatcaagcagaaaggccgtgaaggaaaatggatcttcaaaaaagcgatggaaccttatctgccgcacgacatcatttaccggcctaaaaccggcttcggtgtgccgttgcgcaactggttgcaggggcgattgaagccgctggtcgatgaagtgctgtctccagcctcgttgcttcagcgaggaatttttgatccgcaagcggtcgcgcgcctgatcgaggctgatcgttcagggcgcattgatgcggcctacaccttgtttggcatcgtttgtatggagttgtggtgcaaacagtaccttgatggcaacttcgcccttgatcgctgacagcagcgaggccccgcgcaaccaaggttgcgcgggaatcaggggctctgtgtaaatacggattgtatgaaccgatgttaatctaggcggctagacacaagattctcagtgatgagtgaaatttttaactttattggtacgaatgcatgaagcaggttgttcagaatatggctagcggtgagacgtcattggttaatgcgcctgccccgactgttcgtagtggcgctttacagatcaacacgaccaatacgctgatttctgctggcacggagcgcatgcttgtgggctttggccgggctaattggctggaaaaggcccgtcagcaacccgataaggtccgtatggttctgcagaaggtccagactgatggtttggcaactactgtagaagccgttcgctcgaagctggcgcaacctttgccgctgggatattgcaacgtcggtgttgtcgcggcagtaggcaatcatgtgtccggtttcaagcaaggtgacagagtcgtttccaatggtcctcatgccgatgtggtgatcgttccaaaaaatctctgtgccgtcattccggattcggtcagtgacgaagcagcttcgtttaccgtcctggccagcatcggcctgcaaggcatccggctggctcagccgacgctgggagaggcctttgtcgtcaccggcgttggtctgatcggtctgatgaccgtccagctcttgcgcgcccagggctgccgtgtgcttgccatcgattttgatgaccagaaactggccttggcgcgtagctacggtgccgaaacctgcaatccgggcaagggcgaggatgctgttgccgccggtatgatgttcagccgttccagaggtgttgacggcgttatcattaccgcctccaccaagtcgactgatccggtcacccaagccgcgcatatgtgtcgcaagcgcgggcgcattgtgcttgtaggtgtcactggcctggagctgaatcgggccgatttctatgaaaaagaactgacattccaggtttcatgctcctacggtccagggcgctatgaccctacatacgaagatcagggcaatgacttcccgatcggtttcgttcgctggactgagcaacgtaacttcgaggctgtgttggacatgcttgccagtggccaactggaagtcgattcgctgatttcccatcgttttgcctttgaagacgcggcagatgcttatcagacgctcacggcggataattccgcactgggcatcatcctgcaatattcttcaagtgcggctgagcgcaacatcaagaaagtggtgttggcaccggaagcggtcgcgagcttcaacccggtcaaacccgtggtgggtttcatcggtgctggaaactatgcctcaagaatgctgattcctgctttcaaggcggcaggcgcgcaattccatacgatcgtgaccgcaggtgggatcaacggagtcatccacggcagcaaggccggatttgcggaagcatcgacagatattggggcgatgctgggcaacgacctgatcaataccgtggcgattgtcacccgtcacgatagccatgctcgttttgtcgctcaggcgctcgaggccggcaaacacgtatttgtcgaaaaaccattggccatcgaaacccaagagctggcgatggttgagaaggcttatcagagtgctgtcgagaagggcctcaaatctcatctgatggtgggcttcaatcgacgtttttcgccgcaagtgcagaagatgaaagctttgcttgcagcggtaaaagagccgaaatcctttgtcatgacaatgaatgccggcgctattcccgcgaatcactggacacaggacccagcggttggcggcggacgtattatcggcgaggcctgccacttcattgatctgatgcgtttcctggccggaagcaaaatcgtttcgatccaggcccgtagaatgggcgatacggacgccttggaaatcaccgaagataaagctgcgatcattctgggttttgaagatggttctttcggtaccattcattacctggccaatggtgcgtcgagctttccaaaagagcgcgtggaagtctttgccgcgggccgtgttctgcaactggataacttccgtaaattgaaaggtttcggctggccgggctttaacaagctcaacctgtggaaacagaacaaggggcaaagcgagtgtgcggctgcattccttgctgccgtggagtctggtaaggcgacgccgatctcctccgatgaaatcttcgaagtggcgcgagtgagtatcgagatttcgcggatcctgcgtgagcaatgagcctttttattactaaagccagaactgccgccgcgctagggggcggcaatctggttcgcgcattgatgtatcggcttggggtcaagaccgggttgaaccctgtcagacgtcttttcgctgatatgcctcaggggcctttttttgcgcccggtgccagacgcgccaactcattgcccgtcaatacccaatgggatacccaggcccgctattacgggtgttgggccattcttgtttcagacaatgcgcctgactggcacctgaacccgctcagtggggttcgggttccggatcccgaaagggagtggtggcgcatccctgactttgatgccgctgttggcgacatcaagaatatctgggaagcgtcgcgcctggactggacgctggcatttgctcagcgagcctgctcagacgatgtctcgcagatggagcggctgaaccagtggttgacgcactggtgcaagaataaccctccttattgcggtccgaactggaagtgcggtcaggaggcttccattcgtgttttgcacctggcgatgacggcgatcattctcgagcagtcgtcgacgccgttgcctgggttgatggagcttgtccgactgcacctcaagcgtatcgagccaacgctgagttatgcgatggcccaggacaacaatcacggcacctctgaagctgcggccttgtttgtcggtggtagctggctggcactgtgcaatcatcccgaagggctgcgttggcagcgattgggacgtaggtggctggagaaccgtgccgctcgattgattgagctggacggtagtttcagccagtactcggtcaattatcaccgggtcatgctcgataccttttccatggtcgaggtctggcgaatcaaggccggactcgaggccttctccgcaacctttcaatccaggacgcgcgcggctacgaattggctattttcgctggttgacgagagttccggggatgcgccgaacataggggccaatgatggcgcgcggctgttgccgctgacggacactgactaccgcgatttcaggccggcggttcagttggccatggcgctgttctgcggaaaaagagcctatgcggctccaggggcgtgggatttgcctttgcagtggctgcagctgtccgcgccgtcggctgttgtcgagcgcccggctagccagctgttcgaccagggtggatatgcactattgcgacgcgtagacacccttgccgtgctgcgttatccgcgctttcgttttcgacccagccaggccgatgccttgcacgtggatctctggcgttcgggcctcaatctgctgcgtgacgcaggaacctatagctataacacctcggctcaatggctgagctatttcccgggtaccgtcagccataacaccgtgcaattcgacgggcgtgaccagatgccaagactcagtcgtttcctgtttggcgactggttgcgtacgcgcaaggtcgatggtctgagcgatacaccggaggccactacctgcggtgccagctatagcgacaacgctggtgcctctcatacacgccaggtgcgtctgagcgataccaggttacaggttcgggatgagatcaaagggttcaaagccggcgcggttctgcgctggcgtttgcagcctggcgattggcagatgtcggatggcgtattgagcaacggttcgcaccggatatcggtaacgggcagcatgtcgattgtccggcaggagctggttcagggctgggagtctcgttactacttgcagaagactgaagtgccggtgcttgaaatagaagtggattcggcgggtgttttgattacggagtatcactggtaaacatgaaaattctttattttcatcagcatttttccactccgaaaggagcgactggtattcgttcctacgaaatggcccgtcgcctgattgctcgagggcatcaggtttccatggtatgcggtagctacggcggtgggctgacagggttggaagggccttttgtcggagggaaacgcaagggcaccgtcgacggaatcgaaatcatcgagttcgatctggcgtactccaacagtgatggcctgttcacccgtacactcagtttcctgaaatttgcatttcgcagtatcggcttggcgctgaccgagcgttacgatctggtttttgccacgacaacaccattgacggcagggatccccggtatctttgcccgctggttgcgcaacaagccgtttgtattcgaagtccgcgatctctggcccgaactccccaaggcaatgggcgtcattcgcaaccctctgattctgtctgccatgtcgctgcttgaatgggcaagctatcgttccgcccaccgagttatcgggctttccccgggtattgtcgacggtatcgcccatcgcggtgttgcacgcgatcggatcaccatgatccccaacggctgtgacctcgacatttttaatgcgcccgccgagccatggcggcctgccggtgtggaaaaagatcaactgatggcggtctttgccggtacccacggagttgccaacaagctggattcggtactggatgcggcgaaggaactgaaacttcgccagcgtgacgatatccgcctggtgctgatcgggcagggcaagctgaagccggcgctgcagcagcgagcggccagggaagggctggataatgtgatctttcacgatccggtgaacaaagcgaaattgtccggtctgatggccagcgcagatcttggtttgcagttgctcgctaatgttcctgctttctattacggcacctcccccaacaagtttttcgactacatcgcttcggcattgcctgttctgaataactatccaggctggctggccgaaatgatcaccaaggaagattgcggttttgtcgtgccgccggaaaatccatcgctgttcgccgatgccctgatacaggcagccgatgcccgtgaagaactcaaggccaaaggcctgagaggtcgtgagctggcggtcagagagttcgatcgtcgtaagctggcggatcgatttgtcgattggctggagggtgtggcccgatgatcaagcgtgggttcgatctgcttgcttcgatactgggcctgttgttgctggcaccggtcatggcgatagtcgcctggcagatccgcaagaaacttggttcgcccgtgttgttccgccaggtccggccgggcaaggacggcaagcccttcgagatggtcaagttccgtacgatgcgcgatgctcatgacgcgatgggcaatccactgccggattcggagcgcatgacgccgttcggtagcttcctgcgttcgagcagcctggatgagttgcctgaactgtggaatgtattgaagggcgatatgagcctggtagggccacgacctctgctgatggagtatctgccgctctataatagcgagcagtatcgtcgtcatgaggtgcgtccgggggtgacgggttgggcccagatcaatggacggaacgcgttggagtgggaagaaaaattcaacctggatgtctggtatgtggataaccagtcgttatggctggatctgaaggtcatcttcctgacgatcaagaaggtcgttatccgtgacggtattagcgcggaaggcgaagtcaccgccgccaagtttaccgggaccaagcgatgaaccggctggcagtgctgggagccagcgggcatggcaaggtcgttgcggatacggctgagtgctgtggctggaagattgtcgagttttttgacgatgcctggcccgagcggcggcgcaatggtgcctgggatgttgtgggcgataccgcggcgcttctggccaatctggatctatatgacggtgtgattgtcgcgatcggcaataatcgtattcgtcaggtcaagctcgctcagctcaaggcgatgggtgccaggctgataagccttttgcaccctaactgtactttcagccggtatgccagcctcggtgaagggtcggttgtgtttgccgcggctgtggtgaatgctgatgcgatcgttggcacaggggccattctaaatacaggttgcagcgtcgatcatgattgccgcctgggcgactgtgtacatatcagtcctggtgcccggcttgccggtggcgtatcggtgcaggatctgagctgggtaggtattggtgccagtgtgcggcagcttgtgaacattggggcgcaagtcatgattggtgccggcgcggcagtgatcaaagacgtgccggacaacgttatcgtcgcaggcgtgcctgcccggataatggggcccggtgtttaaagcatcccccagctttttgtagacagcaggagctcatgaggagctctccatattatcgaatgaaaactgacgggtattggttgtgttgaactcacctttttctccctggccttccttttccgacgaagaggccaatgctgtacgtgatgtgatcctgtccaacaaagtcaattactggacgggcacgcaaggacgcgagttcgaaaaggaattcgcggcatgggcgggtacccaatacgccattgcgctggctaacggcacggtcgccctggacctggcccttaaggcgctgggtatcggcgccggcgacgaagtgatcgtcacctcccgtacgttcctcgcatcggtgtccagcattgtcaatgccggggcgactccggttttcgctgatgtggatcgcgactcgcagaacttcactgcgcagaccattcgtgccgtaatgaccccacgcacccgcgcggtcatctgtgtgcatctggctggctggccttgtgatatggacccgatcatggcgctggcgcaggagttcgatctcaaggttatcgaggactgcgcccaggcccatggttccctgtacaaagggcgccctgtcggttcgatcggccatgtcggtgcttggtctttctgtcaggacaagatcatgaccactggcggtgagggcggtatggtcaccaccaatgatcgcggtttgtgggcagacatgtgggccttcaaggaccacggcaagagctgggaggctgtctatgaacgcgagcatccaccaggtttccgctgggtgcacgaaagttttggcactaactggcggatgctggaagtccaggccgtgattggccggattcaactcaagcgcatgaccgattggcaggcaagccgcctgcagaacgcacagcagatttgggattgcgctcgccaactgaatggcctgcgtactccggcgatacccgaaggcagtgttcatgcggcctacaagtgctatgtattcgtggaaccgcaacagcttaaggacgggtgggacagggaccgtattctcgcggagattacagcgcgggaagtcccggtattctccggctcctgttccgaggtctatctggaaaaagccttcgacaatactgactggcgccccgcgactcgcttgccgattgctcgagagctgggtgaaaccagcctcatgttcctggtacaccctacgctgaaggcatctgaaatcgagaaaacgtgctcggtgctcaaagaggtcatgcaactggccgcacggtaactatcagccaacgttgtgcggtggggcggtttccgctccctgcacaaaaagaattcggctgctgggctgtaaagcgggcttgcctgttgtcataaaatggaacttcttgggatcacccagtgtggcaccagatatatttcaggagtaatagaggtgttcaaggtgttatggataagttgagagcctttttactgggattaacgcgccggcaaaagcgtgcctttcaggtggtgactgacgttgtcctcgtctggtttgccctctggatggcctttgtcgttcgtttaggcgtcgatgagctggtcaatccctttgctgattacctctggttatttttgagtgccactgttgtcgccatcccattgttcatacgcttcggcatgtaccgtgccgtcatgcgttatttcggtaacgatgcgctgatcaccattatcaaggctgtcagcctgtcggcgctcattctcgccctgatcgtgtattggagcagcagccgtcaaccgctggtacccagatcgataatcttcaactattggtggctaagcctggtgatgatcggtgggttgcgtctcgcgatgcgccagtacttcctgggcgactggttcacggccgcgcagcatgttccctttaccagccgggatgacggtttgccgaaggtggccatttacggcgccggtgcggcgggtaaccagttggtcgccgcgttgcggatgggccgcctgatgcgtcctgtggcattcatcgacgacgacagcaatattgccgagcgagtgatttccgggctgcacgtctataagcccaaacatattcagcaaatgatcgatgtgaccggtgcccagcagatcctgctggcgatcccttctgcaaaccgtacgcgccgccgagagatcctgagcttcctcgaggggttcggcctgcacgtgcaaagtgtgccgggctttatggatctggcgagcggacgggtcaaggtcgatgatattcaggaggtcgatattgccgacctgttgggacgtgactcggtcccgcctcaggaggagttgcttgagcattgcatcaaggaacagtcggttctgatcacgggggccggtggttcgatcggttcggaactgtgccgtcagattcttgcgttgcgcccgaccacgatgctgctctacgagcacagtgagttcaatctctacagcatcttgcaggagctcgaacagcgtatcgtgcgcgagtcgctgtccgtgaagttactgccgatcctggggtctgtgcgtaatcaggaaaagttgctcgacatcatgcaaacctggcatgtggatacggtgtatcacgccgcagcctacaagcatgtccccatggtcgagcacaatattgctgaagggctgttgaataatgtgatgggcacattgagtacggcgcaggccgctcttcgtgcgaatgtcgcgaacttcgtgctgatttctacggataaagcggtacgcccgacgaatgtcatgggcagtaccaaacgtctggccgaaatgacgctgcaggctctgagccgtgaggtggctccagtattgttcggagagcacgccaatgtttcccgggtgaataaaacccgctttaccatggtgcgttttggcaatgtgctgggctcttccggctcggtcattccgttgtttcacaagcagatcaagtccggtggaccgctgaccgtcacgcatccccgtatcacgcgttatttcatgactattccggaagctgcccagttggtgatccaggcaggttccatggggcaggggggggatgtgtttgtgctggatatgggcgagccggtcaggattgtcgaactggccgagaagatggttcatctgtccgggttgagcctgcgttccgaaaagaatccccacggcgacatagccgtcgagttcaccggactgcggccgggcgaaaagctctacgaagaactgttgatcggcgacaacgtcgtggcgacacagcatccaatgatcatgagcgccaacgaagactatctgccttgggatgtattgaaggccaggctgggcgagttgctgttggcggtcgaccaggatgattactcgagagtccggcaactgttgcgcgacaccgtcagtggctacactccggatagcgagattgtcgactggatttatcagcagcgtcggcttgagccctagttgcatcattagcccctcggtcacgggaacttactgtttggtgctgaggggcgattacacttgttaagcattacctgcgttcttgctgtacttacacagagtagacactatggggatggctctgccttgacccaacggtaaaaatgctctgctctgcaactacaaaaataaaaaacatattgaagtggtcagccgggaccgtagtctggttccagactttgctgccacgacatgccgttggagtcggcaccttgagctttcaagcatcgtctgacttatggtttccctggatagggcttttgtgctcgctactgatcatggcgatcctctcgctgggggtgactggtgcctttcttcgttatgcgcttgctcacaggctgatggagattccgaacgcacgcagctcccattccattcctacaccgcgtagtggcggagtaggcatcgtcctgaccttccttattgccttgcccttggccggaatgcttggcgctatcaaccagaatctggtctggagcctgtcaggcgctggtgctggcattgctttgctcgggtttattgacgatcaccggcccattgcagcccgctggcgtttgctcggacattttgcgggtagtctctgggcgttgttctggctgggaggattaccggcgctcgaggtgttcggcatgacgctagagcttggctggatcgggcatgggctggcggtggtgtatctggtctggatgttgaacctctacaacttcatggatggcatcgatgggattgctagtgtcgaagccgtgacatcctgcctgagcatttgcctgatctattggctgtcgggatatgacgagctgatctggccgccgttgctgcttgccacctccgcgctgggtttcctgtactggaatttcccgccggcgaaaatcttcatgggtgatatcggcagcggtttcctggggattgtgctgggtattctttcgctgcaggccgcctggagaaacgccgacttcctgtgggtatggtgcattttgctcggggtgttcatcgttgatgcgacctttaccttgatccggcgttttttacgtggagagcgtatctatgaagctcatcgcagccatggttatcaattcgcttcacgccaactgggaagtcatttcccggtgaccttgggcgttgcattgatcaaccttctctggctgttacccatcggtctgtgcgtcgccatgcagaagctggacggaggattgggggtaatcatggcctatgtacctttgctcatcctggcggtgaagtatcgggccggtgagtcggaacaccgagcagatggatgaggctttactattacataatctgtaattaatccctttttgacagtgcatcaccatgacctaagtttgaggggcagcttcggaaaagctgcatctctatcaacggtgtcatggagtgtcacttatgcgtgcaaattatttatattccttactttttgccctgctgactagcgcctctatcagtgtaattgctgctcccgcgtcgaaacaggaggcagcaagcacggcgccagtcgtgactgcggctgttgccccacaaactgccacggtcgatatcaacaaggctgatgcggctacgttgcagcgtgagttgttgggagtcggtgaggtaaaagccaaggcaattgttgcatatcgtgagactaatggagctttctcgtcagtggacgaactgctcgaggtcaagggaatcggcaaggcgattctggaaagcaaccgggaaaaattgaaggtcaactgacgcttcaattcatgcgcaaggccgatcactgatcggccttgcgtttttcgggcccaccataagcaaggttgtgccattcaatgttgtctatcgtatcgatagaattatgatcgtaatattttattgaattatgactataatcaaaccgcttcccaagcagcgcatcaattccttgtctttcccttctcaagcacttttctggagagccgtcatgaattcgatttcccccaaggggctggcacttgtcaccggggcttcatctggcatcggtgcggtttatgccgagcggctggccgctcgtggttacgatctgttgctggttgcacgcgatgagcagcgcctgcaagccgccgcgacccggttacgggccgagcacaaggtgcaggttgaagtgttgaaggccgatctgacgctccaggtcgatgtgctgaaggtcgagcagcgcttgcgttccgactcgagcatcagtctattgctgaacaatgccggtatcgctgctgacgggaacctggccgttgccgacacggatcagctggaggcaatgatccagttgaatgtggttgcggtcactcgtctggctgctgcggccgccgccagcttttcggcggcgggaagaggagcgattatcaatatcgcttcggtggtggcgctgattcccgagcgttttaatgcgacctacagcgcgaccaaggcctatgtcctgagcctgactcagtcgcttgctgcggaattggacggtaagggtgtgcaggtccaggcggtattgcctggggtgacccgcactgagatctgggagcgctcgggcatcgacgcgcaagggattccagccgagatgatcatggaagccaccgagatggtggatgcggctctggccggttttgatcagggtgagttgatcaccatcccctcgctacccgactcggcagattgggactcctttgtagctgcgcgttttgccctagggccaaacctgtcgaaaagtagtgcggctgctcgctacaaataacggtgtcgaggctggaggttggtgcggatcactccgcctgaccatcctgttttttcagatgctcgcgtgttacctccagtatccgtttggccaggtcggggttctcgacactgcgcgacagcaccagggccccgaccagggtcgacatgatcactaggctctggtcggcggcattttctccttcgagattggcctctacctgcgcgagtcgggcattgagcaccgcatcagtggtgggactggcttgcccgcgcaggcccagttccgaagacatggtgggcagcgggcagccttcacctggggaggtctgatgccactcggacagatagctgttgataaaggccggcaggggttgttcctgggcaaatagcgtggcgcagtgcgcatcgagttcttccgccgcggcctgcagggctttttcgaccagttcgtccttagatttgaaatgcgagtaaaaaccgccatgggtcaggcccagggctttcatcagtggttgcaggcctgtcgccccgataccgtcgcgccgaaagcgctcggcggcctccttgatgacgcgttgatgagtttgggccttatggtcgtgcgagtaacgcatcggggaagtctccacagctagggagtcatcttacccaaggttgacggaagggggattgcactattaaccccggaaacctcatttctctcactgaatagctagaaaagcatgattcgtcagtgagccaagtatcgattggcatgaatagtgactattggatatccatagattgttcaacaatcgcaaggcaatattcatgagcaacgtactctccctggccgatcagataaccctcgaattacgtgccgatatcatcggcggtcgcttgctgccaggcatggccctggtggaaagcgatctggtgtccgcctacaacgcctcgcgcaacaccattcgcgaggccttgcatcgcctggggcaggaaggcctgacccgctacgcacgcaataaaggcgtcacggtgcgcaggctgggcattgatgaagtgcgtgatctgttccaggtacgccgtaccctggagttgcaggccattgcctccagcaaaccgctgcgcgactaccagtccgatcggatgctcgaggctatcgaggccagcgaactcgcccgcgagcgcgaggactggcgctcggtgggcacccacagcctggcctttcatcaacacatcgtcggactgatgcgcagccccttgttcgatgagttcttcaccaacgtcgtggcgcagatgcgcctggtgttttgtgccgcccctgacgagcagcattttcaatcgccctggctggcccgggaccggcagatccatgacttgctcgccgctggcgacaagcaggccgccagcgaaaccctggtggtttacctggacgattccgaacggctgctgctcgacattctcagccactcttcccgccactgatcgagggtttcaaccatgtacaaagactatcccgcggcttatcaggtcagcaaaggctcggccctgcaggtggacacggccttttatgagcgggtccgcgacagcaaggaccaacgcaccttgatcgagcaattcgaagtgccgatccgcaccgggcgtgcctggcatgtgccggctgggcacgtgttccgggtgaccacgccggccggcccgcaggtcggagacttcaacgtctggaatgccagcgatccgcgggagcgtctgtgggcggcgcgtacccggcagttgcagggcgcgcatgtcagtacccatgaccggttgtggtcgaacctgccgtttttgcggccattggtgaccatcaccgatgacagtctcgccggttacgggatcgacgagcatggcgggcgcttgcacgacctgctcggcacgcgctgcgatccttatgtgaaccgcatgctcaccggggaggacttctatcaccattgccattccaacctgacgcgcgcggtcctgcctcacggcctgaccgagttcgatgtgcatgacgtgctgaacatcttccagtgcaccgggctcaatcatgacgacatgtacttcatgaaggcctgtcccgcgcagaagggcgattacctggagttctttgccgaaatcgatctattgtgcgcgctgtcgacctgcccgggcggcgatctgtcgctgcccatgtgggggccggaggctcaggacccgctcagtgtctgtcggccgttgggcgtggagatctatcggctcgacgaggcattgctcgaaggttggagccagcctgagcgggcggcctacaaaggtttgcatggcctgcacatcgccaaggctgcttgggagaaatagcgctgccggccgcaggggcggataaaaaagccccgccatttcgagaagggcggggctgttcgatcgggttatccagtcagcggtcctgcgcgtccttggcgtccgcttccgcgttgcgctcagcaacgcgcttgcgttgctcttcggtcagttccaccttgttggcggtgtcgcgcaacatcatcagaccgccaacgatcgagcctattgcaacgatcagaatcaaccaggcataccagggcatagggctctccttgagggcataccggcgggcgaggagtttcgcccgtcaagctgccataccacttcgagttacagcgtttcgcagtggttccattgtaggcctgatctgccccggtaacctctcttgcatcaatcttctcgaaggttgcattcggccatgcaagccaactacagagagatgccatcccctcggagcccggtcagcattgcatccgccggcgcatcggcgcgcagttgcgcggtcagttggaagtagatgaagccggccaccatgaaaccgaggaagatcaggccgatcaggctgttgaaccaggccatcgccaccaggcagaccacggccagtgccagggcaatggtggggaccagcgggtagcccggtgcgcggaaggtgcgttccaggtgcggctcggccttacgcaacttgaacaggctgagcatgctcatgatgtacatcacgatggcgccgaatacggccatggtgatcattgccgcggtcagggtcatgccgcccaggttgatcaggccatcgctgtagatggcggcgatgccgatcaggccgccggcgatgatggcgcggtgtggcgtctggaagcgtgacagcttggccagcgacgccggcagatagccggcgcgggcgagggcgaagaactgccgcgagtagccgagaatgatgccgtggaagctcgccaccaggccgaacaggccgatccacaccagcatgtgcagccagccggagttgtccccgaccacggctttcatcgcctggggcagcgggtcgttgatgttcgacagggtgcgccagtcgcccacgccgccggcgaagaacatcacgcccatggccagcagcaccagggtcagaatgccgctgatgtaggccttggggatggtgcgtttcgggtccttggcttcttcggcggccatggccgcgccttcgatggcgaggaagaaccagatggcgaacggaatcgccgcgaacatcccggcaatcgccggcgcgccgaaggtgtccgagcccgcccagccgttgagggcgaagttgctgaagctgaaggccggcgcgaccacgcccatgaacaccagcagttccgccaccgccagtacgcagaccaccagctcgaaggtggcggcgagtttgaccccgaggatgttcagccccatgaacacgatataggcgccgaccgccgcatgcttcgggtccagggccgggaactgcacattcaggtaggcaccgatcgccagggcgatggccggtggcgcgaagacgaattcgatcagggtcgccagcccggcgatcagcccgcccttttcaccgaaggcccggcggctgtaggcaaaaggcccgccggcatggggaatggcggtggtcagttcggtgaagctgaagatgaaacaggtgtacatggccgcgaccatcagcgaggtcagcagaaagcccagggtgccggcgacgccccagccataactccagccgaagtattccccggagatcaccagcccgaccgcgatcccccataaatgcagcgtgcccagcgttggtttgagttgtgtgttcatgcgtggctcccggaacggaatgaaatgctcgggactgctcattgcaccgctcatgccagagcgaaaacggccgtcgtaaagcgcaaaaagctgtcgtatcgaggatgtttccagttgtttcggggccgaaggcgcctgggttggtgcacagccgtgcaacagaggagggcggtggaagctggaggcgcgcgatcgcgagcaggctcgtttctacgtgcatcgtgcttttccggtgcagcagcaaaccggctggcgatcccttcccctggtcacgccggtggccggtgtaaatcccgcgtaaagcctttctttacgctttctttatgcgccgcccgcgccctcgatctcgttcctttacagcctccctgcggacaatgccccacacgcggcgattgccgtacgacggagagattccatgagcgttctggacggggtgtccctgctgctggcagtggggctgttcatctatctactggttgcgctgttgcgcgcggatcggaactaggagcggctatgcacagttatgactattggctgatcctcggcttctttgccttggtgctgctgcccgcgcctttcctggggcggttctactacaaggtaatggagggccagcgcacctggctgacgccgctgttggggccggtcgaacgcgcttgttaccggctttcgggcgtcgatgcgcaaagcgaacagagctggcagaaatacaccctggccctgcttgcgttcaacctggccggcttcctgttgctgttcacgattctgttgttccaggaccatctgccgctcaacccgcagaacctgccggggcaggagtggacgctggcgttcaacaccgcggtcagcttcatgaccaacaccaactggcagtcctacagcggtgaagcctccctgagctacctgagccagatgatcggcctgaccgtgcagaacttcgtcagcgccgccaccggtttggcggtgctggttgcactgtgtcgtggcatcggccgcaagtcgaccaagaccctgggcaacttctgggtcgacatgacccgtgccaccctctacggcctgctgccgctgtgcctgctgctggcattgttcctggtgtggcagggcgtcccgcaaaccttcgcccagtatgtccacgccgtgaccctgcaaggcgtcgatcaggtgattccattgggcccggccgccagccagatcgccatcaagcaactgggcaccaacggcggaggcttctttggcgtcaactcggcgcatccgttcgagaacccgacggcctggagcaacctgttcgaggtggcctcgatcatcctgatcccggtggccctggtgttcactttcggccactacgtcaaggacctgcgccagagccgggcgatcatcgcctgcatgctggcgttgttcctgatcggtggcgcgacctcgctgtgggccgagtaccagcccaacccgaccctgaacaacgtcgcggtcgaacagaccgcaccgctcgagggcaaggaagcgcgcttcgggaccaccgccaccgtgctctggtcggtgaccaccaccgcggcctccaacggttcggtcaacggcatgcatgacagcctcagcccgctgagcggcatggtcgcgctgatcaacatgatggtcggcgaggtgatcttcggcggcgtcggcgcgggcctctacggcatgttgctgaacgtgctgatcgcggtcttcctcgccggcctgatgatcgggcgcaccccggaatacctgggcaagaagctgcaggccagggaagtacagttgctggtggtgacactgatggtgatgccggtcggcgtgctggtactgagcgccatcgccgcgagcctgccggggccggtggcggcggtgagcaaccctggcgcccacggtttcagccagttgctgtacgcctacacctcggccagcgccaacaacggctcggccttcgccggcctgggcgccaacaccccgttccacaacctgatgctgggcctgggcatgttgatcggccgcttcggctacatcctgccggtgctggccctggccggcagcctggcgctgaaaaagaccgcgccggtcggccagaacagcttcccgacccatggtccgctgttcgtcacgctgctgaccatgaccattttgctggtgggcgggctgacctttttgccgaccctggcgctgggcccgattgccgaccacttgagcttggctgcctttggaatgaagggctgaggacttaatgatgaatatgcctgttcctgcctccaagaaggctgtaactgaaaaaaagcccggcgctaaaaccgtggcttcgcaacacacgagcgacgagcaacagaaaaccttgatcgcagccctgtggcgtccggcgctggtacaggccttcgtcaagctcgacccgcgccagctgcaacgttcgccggtgatgctggtggtcgagctgaccgcgatcctgaccacggtgctgtgccttgtgccggacaccgcggtgccgaccttcgtcgccgcgcagatcgctctctggctgtggttcaccgtgctgttcgccaacttcgccgaagcgctggccgaagggcgtggcaaggcccgcgccgacagcctcaaggccggcagcgaaggcctgagtgcgcggctgaaaaaggccgatggcagcttccaggtgatccctgccgccaatctgcgcaaaggcgatatggtgcgggtcgaggccggtgagatgatccccggtgacggtgaagtcatcgaaggcattgccgcggtcaacgaggcggcgatcactggcgagtcggcaccggtcattcgcgagtccggcggcgatcgctcggccgtgaccggcaatacgcgcctggtgtccgactggctgctggtgcgcattaccagcaatccgggcgaatcgaccctcgaccgcatgatcgccctggtggagggcgccaagcgccagaagacccccaacgaagtggccctggacatcctgctgatcggcctgaccctgatcttcctgatcgtggtcgtgaccctgcagccgttcgcccacttcgccaatggcagcctgccgctggtgttcctggtggcgttgctggtgaccctgattccgaccaccatcggtggcctgctgtcggccatcgggatcgccgggatggaccgcctggtgcggctgaacgtgatcgccaaatccggtcgcgcagtggaagcggcgggtgacgtgcatgtgctgttgctggacaagaccggcactatcactttcggtaaccgtcgttgcgcggccatccactcggcgcctggggtcaaccaccaggaaatggccgaggccaccttgctggcctcgctggcagacgacacggcggaaggcaaatccatcgtcgaatacctgcgcgggctttatccacagcccgagccgggcgccgatgcgctgaccgccgtgccgttcagcgcggaaacccggctgtccggtgtcgactaccaggggcgggtctatcgcaagggcgcggtggattcggtgctggctttcgtcggcctgcaacgtggcgacctggccccggcgttgtcccgggaaatcgacaagatcgcccagagtggcggcacgccgttactggtgtgcgccgagggcaagctgctcggcgccattcacctcaaggacgtagtcaagcccggtatccgcgagcgtttcgccgagctgcgcaagctggggatccgcaccgtgatggtgaccggcgacaacccgctgaccgccgctgccattgccgcggaggccggggtggatgacgtgctggccgaagccacgccggagaaaaagctggcgcgcattcgccacgagcagaacgacggccgcctggtcgccatgtgcggcgacggcgccaacgatgcaccggcgctggcccaggccgacgttggcatggcgatgaacgatggcacccaggcggcgcgcgaagcggcgaacatggtcgacctcgacagcgatccgaccaagctgctggacgtggtgcagatcggcaaggaactgctggtgacccgtggcgccctgaccactttttccattgccaacgacatcgccaagtacttcgcgatcctgccggcgctgttcgcggcgatttatccacagctcggcgtgctcaacatcatgcaactgagcagcccgcagagcgcgatcctctcggcgatcgtgttcaacgccctgatcatcgtcgtgctgatcccgctggccctgcgcggggtgcgggtgcaggcggccagcgcggcccatctgttgcgccgcaacctgctgatctatggcctgggcgggatcctggtgccgttcctgggcatcaagttgatcgatatgctgctgacggctttgcacctggtgtaaccgcattcctggaggcgcgagcctgctggcgaggcggtgtcactgacgcactgccagcaggctggctcctgcagcgtttggggtgaacttgttaaccgaatcgaggatttgatgatgtccactgtattgcgtccggccttgagcctgattgtgttgatgaccctgatcacgggcgtggcctatccgctggtggtcaccggcgtggcccaggtggcgttcccgaaacaggccaatggcagcctggtgctcgatggcgcgggccaggtccgtggttcggccctgatcgcccaggatttcagcggcgacagctggttccacccgcgtccatcggccggggcttttgccacggtgtccagcagcgcgagcaacctggcgccgagcaacccggcgctggccagccgtgtgatcgacgacgccaacaagctggcggtgccagggcaggggccggtaccgctggcgttgctgacgacttcgggcagcggcctggatccgcacttgccaccggcggcgattaactatcaactggcgcgggtcgcggcggcgcgcaacctgccggtcgccacgttgcagcagttggtggatgctcatgtcgagcagcctctggtcggcccgccggtggtgaatgtgctggccttgaactgggcgctggaaaagctcgccctgtagccaactgctacaagtttgtatgtcgatgatttgagtccagagagaacaatgcatgagtgattccggccgcgccgacgccctgttagccgatctgtcccatgacggccgcggccggctcaaggtcttccttggcgccgccccgggcgtcggcaagacctacgccatgttgcaggcggcgcacacgcaattgcgccagggggtgaagatcctggccggggtggtggaaacccatggccgggcggaaaccgaagccttgctcggtggcttgccgcaacagccgttggtgcgttccgaataccgcggggtcatgctcgaagagatggacctcgacggcctgctcaaggccaagcccaagctggtattggtggatgaactggcccataccaacgcccccggcagtcggcacgccaagcgctggcaagatgttcaggaactgctggcggccggtattgacgtcttcacgacggtcaacgtgcagcatctggaaagcctcaacgatcaggtccgcggcattaccggggtgcaggtccgcgagaccctgcccgactgggtgctgcaggaagcctacgagttgctgctggtggacctgccgccgcgagaactgctggagcgcctgcgcgaaggcaaggtgtatgtgccggagcaggccagggcggcgatcgatgcgttcttcacccagaccaacctcaccgcgctgcgcgagctggcgatgcaggccgcggcggcgcaggtcgacgacgatctggcccaggggtatcgcaagctcgggcaggccgcgccggcggtgcgcgggcgcttgctggtaggggtcgatggcgacgcccaggcggagcgcctggtgcgtcatgccagccatgtcgcccggcggcggcatctgccctggagcctggtgcatgtggatgacggccgggtgcctgacgagcaagctcgccagcgcctgcaaagtgcccagcaactggccgagcgcctgggcggcgaggtggtcctgctgcgggctggcgaagtggccaagaccctgatccagcatgccgcggagcggcgcgccagcctggtgctggtggggcagtcacgcaaacgcctgcgccgccgtttgttcggcggcggcctggcggcgcgcctgctgcgcaacgcccagggcctggaaatcaacgtgctcgacagcgaggacgaacccggccagccgcgcctgcgggtggagcgttcgctggtctggttcgactacgccctggcggtcctggcgacggtcctggcttcggggctgtcgtgggcggtggcgagcgtgctggcgttgccgaacatctccctggtgttccttgccgcggtgctgctggtggcggtgcgcagcagtctcgggccggcgctggtgtgcgcggcgttgtcgttcctgacctacgatttcctgttcattccgccgacgttctccttcgccatccagcgcgaggaggacgtactgacgctgctgtttttcctgttgatggcggccctgaccggcaacctggcggcgcgccagcgtcggcagttgcaggcattgcgcgacacccaggaagaaaccagcgaactgctggacctgtcgcgcaaactcaccgccgccaccgaccggcaggcggtggtcagcgccgcggcgcagcacctcaatggctggaaggagttgcagctgtgcctgctcaatcgcgacgggcagggtggctggaaggtcgagacgggtgggcccttgcagttttccgagtctgaacgagccgccgccgactgggcctggcaacacgatcaaccggccgggatgggcaccggaaccctgcctttcgggcgctggtggtggtggccgttatccgtcgacgagggcccgctgggcttgcttggagtctgtccgaaagaaggcgaggagctcaacgctcagcgtcgtcgcctgttgagtgccttgagccagcccctggcccaggccttggcccgggcacagttggccgaggatctggaagcggcgcgcctgcacggcgaaaccgaacaattgcgcagtgcgctgctggcctcggtgtcccatgacctgcgtacccccttgacctcgatgcgcggcagcatcgacagcctgctggcgctgggggaggcgatccccctggaagaccgtcgcgaactgctcgaaggcacgcgggatgaggccgaacgcctggatcgctacattcagaatctgctggacatgacccgtctcggccatggctcgttgaagctggcgcgagactgggtggcgccggccgatatcgttggcagcgcgctgaatcgcctgcgagtggtgctggcgccgctgcgggtcagcaccgaattgccggccgaactgccgttgctgttcgtgcatgcggcgttgatcgaacaggcgctgatcaatgtactggaaaacgccgcgcgcttttcaccgtccaacggccgtttgcaactgagtgtcgggacccgcgataccgagctgctgtttgccgtgagcgacgaggggccgggaattccggtggaagatcggccgcggattttcgacatgttctacaccgcggcacggggcgatcgcggtgggcagggcaccggcctggggctggcgatctgtcagggcatggtcggtgcccacggcgggcgcatcacggtgggcgaagggatcgacgggcgtggtacctgcatcaccttgtgcctgccgctgcaggcgcaacccgagcttgaaggagaggcctgagtgccggtaaaaaagcgtcaatccaacgaggccaggagggccgcacatgttctttacgatccagagccacgcctgcgctactcttgcgccacttatttgtcttgaagcgaaaccatgagccagaccgcgaccatcctggtcatcgatgacgagccgcagatccgtaaattcctgcgcatcagcctggtgtcccagggctacaaagtgcttgaagccggcaccggcaacgaaggcctggcccaggcggcgctgaacaagccggacttgctggtgctcgacctcggcctgccggatatggacggccagcaggtgctgcgtgagtttcgcgagtggtcgggcgtaccggtgctggtgttgtcggtgcgggccagcgaagggcagaaggtcgaagcgctggacggtggcgccaacgactacgtgaccaagccctttggcatccaggagttcctggcgcgtattcgtgcgctgttgcgccaggcacccgtcggcgaagcgcaggaagcagccctggatttcggcccgctgaccgtggacctggcgtatcgccgggtactgctcgacggtgccgaagtggcgctgacgcgcaaggaatacgccgtgctggcgcaactggcgcggcacccgggacgggtgatcacccagcagcaactgctcaaggatatctgggggccgacgcacaccgaggacagtcactacctgcgtatcgtggtcgggcatctgcggcagaagctggcggacgatccgacccggccgcgctttatcgtgaccgaggccggcgtgggctaccggttgctgggggcgcaggagtgaacgggctcgcggccctctttcaattcagctcgttctcgtagcggtccagggtgtcgctggcaatctcccgtcccagtgcgatcagctccggagccttgtagaactcgaagaaacggcacacccgcttgggcacgttgatcaggatgtccggcgggtagccggcgatcttgtactgcgccagcgaggtctgcatcacctcgaagctctggttgatcaggtccagcagggacgcggggccgacgttatcgataatgaacgagccggtggccgatttcggggcgccgtcggtttccggagccgcggccggttgctgggcctcgggctcggcggattcgatccaggggttaccgatgtcggccgcctcgctgcgcagggcttcctgttcgagcagcagcagttgttcggcttgcttgcggcgaaagggcaggtgcgagcccagggagttgatcaggctgtcgaagcggatcttgaaggcggcgggacgctggatcaccggcaactgataacgacgctggttggtcgagttgaggttgacggcgatgatcaggtcgcagtggctggagaccaccggcacgatcggcagcgggttgagcaagccgccgtccaccagcatgcggttgccttgcatgaccggggtgaacaggctggggatcgccgccgaagcccgcatggcctggtgcaggcagccttcctggaaccagatttcctgctggttggtcaggtcggtggccacggcggtgtaaggaatgcgcaggtcttcgatgttgatttcgccgacgatcttgcggatctggccgaacaccttttctccacgtatcgcacccaggcgaaagctgacatccaccagccgcaacacatccaggtagtccaggctttcgatccagctgcggtagtcgtccagtttgccggcggcgtaaatgccaccgaccacggcccccatggaacaacctgcgacacaggcaatgtcgtaaccacgtctttcgatttcttcaatcaccccgatgtgggcgtaaccccgggcaccaccagagcccaggaccagtgcgacacgctttttcatgactcgatccttcgccagacaggtttccacaatgcacccatcgagggtttcggttcaatcactgatgcctgcccgggccttgggcaaagggatttttccactgtcttgccgcatgcggttatgctcgcgcgactatattttcccttgacgggccaaggcacttttagcggcggcgatcgtcttaggttcacgattgttttttgttcaagactgtttcccccctactttgaggtgtcaatgatgaaagcctggatctgtctaccgttgattgcattggtactcgctggttgtgctggcaagaccgcctatcgcgacagctgtggttcgcaactggatgcggcctggcatgaactggatctggccaaggccgaaggttttgcgggcacagtcagttattccaaagccttgtcgctgctgaccggggccaagacccagcagcaattcgaagccttcgagggttgcaccaaaaaagccgagaaggcccgtttctatattcgtgagtcgcgcgccggccgctgatcgcaaggctgccgtttgccgctagactgaagagcgctcttcagtttccgtctcgcgggcgccgtggttgcgcctgccagtcatgccagggcccggccgcagtctttgtgctgcgggccgggtcattcgtttcgggagtcaatgatgtctgccttggttgatcagttggtggctcaggtgttggggctggaggtgcgcttgctggcgtgccaggcgcgtttgcaggcagtgaccgacaccgaggcgctgcacgatctgcgtaccacggtgcgccgtttgcgcagcctgttgcgagcactgcgtggtttgcccggtgtcgagcaactggaagcggccgcctcggcggtcgggcaattgacgacaccgttgcgcgaccgcgaggtcctggccgcgtacttgcatcaacgtggctaccatcaggccgcggagcgccgcaccacgggcctggcggacgagtatcggacggtggcggcgggcgccgaactcaagcaattgctgctggtgctggatgccttcccgcgcttcctgcgggcggcgcaacgtcaggaactgttgcgcggtttgcgcaagcgcatcgaaaagcgcctggccaagcaatggaaggcactggaccaggccctgcatgatccggctcatgaccggcaccgtttacgcctgctgatcaagcgtgtgcgctacgcggccgaggcttaccccgaacttgccgaactgtcgcccaaggcggtctcgtacttgaaggctgcacagggcgcgctgggcgactggcatgattgctggcaatggctggcccaggctgaacggcaggcggacctattgccttgtgttccggtctggcacgccaccatgcacaaggccgaagtccgtgccgatcgggtactcgacaagctgagcgctgcctgcttccgtggctgaaaggcgtctggcggcttatctgtcagtctttttggcgggaatagatgctttacccttgtgcgctgctggttaagatcctcgaacctttcctttgaccagaggtgctcatgcgcttttccgatttgctcgatgccgtccgccaacatccgttggaactgtcgattccaaccgagtgggcgcaggggcgggccagtttcggcggattggtagcggctttgcagtatgaagccatgcgcgcaaaagtccccgccgagcgtccggtgcgttcgttggcgatcacctttgtcggtccggtcacccccgatgtgccggtcagctttgaagtcgaggtgctgcgcgagggcaaggccgtcagccaggtgctggggcgtgcggtgcaggacgatcaggtagtgactctggtgcagggcagttttggtgcctctcggccgtccgaggtggcggttgtcgccgaggaagcgcctgccatgaaacattgggacgaatgcccggagctgccttacgtcaaggacgtgacgccggagttcatgcgtcatctggcaatgcgctggagcatcggcggcatgccgttcaccggcaacaagtcgcgagacatgggcggctgggtgcgcctgcgtggcgatgtgaaggaagaacccctgaccgaggcacatatccttgcattggtggacgcctggccgccggccttgttaccgcatctgaccagcccggtacccggcagcaccctgacctggaccattgaattcgtgcagccactgctggcgctgagcaccctggactggtgcaagtatcgggtgcatatcgagcatgcccgtgatggttatggccatgcggccgcggcactctggagcgcggaaggtcagttgatcgcgctcagccgacagacagtaaccatcttcggctgacagcctctcaatgccggtggcgctcgcgccaggcacgccaccaggcgccgctgagaacgaagcgtggaaaggtcacgaattgttccaccagcaggcgctggactgcatctttacggtcactgaacggttcggcggcttgcgcctccaggctgtggccgtgacgctgcaggcccaaggctgcaatcaggccgaccacgccgatggcgacgttggtgaagctcaagccgaatacccctgaaaccagcaacagaaagccgacgatgaacagcggcactgcgatcaggtgcaacaccaggttggtcgggttgcggtggttatgcgggtaggagcgccattgccaggcggggagattggggtgacgtttacccatgacggtgatccttgattcgtaaaagctatgtatcaaggataggtctcgcgtggggcttcggcgaatcaaggctggctatgggggcgatagcttggcaagggtttcgccgcggcagggaggctgatcctgccggggcgaaactcgcggttttaaagcttcaactgaccgatggccttgctcaactctccggccagggtcgccagttcgttgctggtggtcgccgagtcgacggtctgttgcacggtgttttcggtgacgtcgcgaatactcaccacggcgcggttcatttcttccgccacctgactttgctgctcggcggccactgcaatctgggtattgctttcacgcatctgcgccacggccgcggtgatttccgccagcgctgtgccggcttcctgtgcctgctgcacgcaatcgtctgccttgaacgagctttcctgcatgaagtccaccgcgtcgcgggtgccggcctgcagggcggagaccatccgggtgatttcatcggtggaggtctgcacccgtttggcgaggttgcgtacttcatcggcgaccaccgcgaacccccggcccatttcaccggcgcgtgccgcttcgatcgcggcgttgagcgccagcaggttggtctgttcggcgatgctgtggatcacgttgaccacgccgttgatcttctgactgtcctcggccaggcgctgaatcatctcggcggtctgttgcacgccggtggagagcccggcgatggacttctgcacgcgtcccaccacttcctggccactgccggccagggcgtcggcggcctgggagcgatcccgggtggcaccggcgtgctgggcgatgtgatagacggtggcggacatttcgttgatcgccgtcgcggcctgatcggtttcgctttgttggccgagcatgccgtgacgcacatcgttcatgctcgacgccaggcgcgaggcaccgatatccagttgccgggcagtattggcgacggtgttgaccacccgctggtaaccggcctgcatcgcgttgaaggcattggccatctggccgacctcgtcggtgcacgacaacggcacgcgcgccgacaggtcgccggttttctccacatgcagcatcacatccttgagggtgttcagttggctgagcaggaaacggatcaacagttgcgaagctccgagcatcgccagcatcagaatgaacacggccactgcgtattggctgaaacgttcgctgaacacctgttgcaggcttggcccatgagcaagtaccgcaacccgttggctatcggcccggggcagcaccagcgcgccgatcagagggttttcaccgaacagcggcatttcgtcgaaggccacccatccattggcgttgctcagttccggcagggggcgttggtcgaagctggggatctggccggccgcgaagctcagcagattctcggcattgggcagcgcttgcccggagggccatgcgccgagcaggctcgcctgggccctggcgttgtgttgtgaggcctggctacgcgcttgctgctccagctggacggcgtacaggaccagtagcagggtggtcgcgaaggcgaccgcattgaccgcccagaacttgtatttcaatgagatattgctgagccaggcacccatggaaggtcttctctgattaagcggaacagtattggcaaggtgccattattgtgccgctatgcagagagtcgaatcttgatatgtgtcaagcaatctcgggcaaggcgaagaaggcacgggcgctggcggtactgtgggccgccagctcttcctggctctcgccgcggtgcagggccacctcgcgcaacacttcggtcaggtaggccggttcgttgcgaccgttcttcggcttggggcgcaggctgcgtggcaacagatagggggcgtcgctttcgagcatcaggcgaccgcggggaatctctcgtaccagcgggtgcaagtgagtgccacggcgctcgtcgcagatccacccggtgatgccaatgtgcaggtcaaggtccaggtaattgaacagcgcgcgctgttcgccggtgaagcaatgcaccaccgcggccggcaagcggtcacgaaagtcgcggactatttccagcaggcgctggctggcgtcgcgttcgtggaggaagaccggcagttgcagttcaacggccagggccaggtgttcctccagcactttttcctgttgccctcggggggagaagtcccgattgaagtccaggccgcattcgcccacggccttgacgctgctttccttgagcaggctgcgcaagcgctgtgcgctgtcggtattccagtcgctggcgcaatgcggatgaatcccggcggtagagaacagttggcggccactttcatccagttgccgcgacagctcgagcgcctgttcgctaccctcgacactggtgccagtgagcaccagctggcagacgccggcggcataggcacggtccagtactgcgtgatgtttttcggcgaaactcggattggtcaggttgacgccgatatcgatgagttgcatggtgctatctccgcctgcggccggaaagcatatcagagctgtagatttataagaaaagccaagaactacaacgagttgaagctgtctcttgatgccggaagaaaggcagcggttggtttgccagccgtggttgtgccagtctttcgcatcttgtcagcgctctaggcgctctgtttctgtcgcccgcgttttcgccattgctcgaaagctcggacagtattcttcccggagagcggatgacgcgaccctcggttttgctagcgttgtgcttgtcgttgctgctgcccctgccggcggtagcacgcttggctggccctccggaagcggccgtagcgggcaaggtccgcgacctggcggacattcgcagcagccgggtcttgcgcgtgctggtcaaccagagtcgcaatagctccggtgaagtccagggccaggccatcggtgtcgaataccaccgtctgcgcgcctttgagcagtacctcaatggtcacgctcgcgacggtcaggaaatcagtctcaagatcattcccaaagccaaggatcaattgctcggtgcgctgcagcgtggcgagggggatctggtcgctccgggagagttgttggaggcgctaccgggacaagcggtaagccccagtgaaccggtcgccagcaacgtgccgttgctgctggtgggaatcaagggtgagcggcgctacactcggcctgaacagctctccggcaagaccctggcgctgaccacaggcagtgctgccggggatgcggtgagccagatcaatcagaggctggcgctgcataagctggcgccggtcaaggtcgagtgggtcgatccgagcctggccgtcgaagatgtcctggaaatggtccagggcgggatctttcacctgaccatcgtcgagaagcccattgccgagcgctggggcaaagtcctgccgaagctgcgttttgatcggcaactggtcatcagcgagcctggcgaggagcactggttcgtgcggcgggacgcctcgatgctgcgggcgagcatcgatcgtttcctgaaggtctataaggctccggcggatcaggatgttgcgttcttgcgcatctatcgacgcctgtatcaggtgcataaccctttgacccgggccgatcgccagcgcctggaaaaattgcgcccggtattacagaagcatgccgatgcccagaacatggactggttgaacctggcggcgctggccttcaaggagtcgtcgttgcaaccctctgccaggagcggcagcggcccgaccggcctgatgcagatcaccccgtcagccgcccagcgggtaggggtcaataacatccagaccctcgataacaacgtgttggccggagccaagtacctggcgttgatccggcgcaagttcttttccagtcccaagctcaacgagcgcgagcgtatggcatttgtcctggcagcctacaacatggggccggagcgagtgcagggtatgcggaccgaagcccggcgacgcggattgaaccccaatcagtggtttttccaggtcgagcgcattgccatggaacaggtcggaatgggcgccgtcagctatgttaatagcgtcaacaaatactatttggcctttgaccgggaacgcgaatcgttggagccgcaagcgcgtaaggtcgtctcaaggaaataatcgataaagttgattgttatcttgctatttttgcacttttaacatgagattttgtgattaatatagcgacccattacccaacactacaaaggactacacagcatgagcacactgatcaaaaccgtactgaacacccgtgcaggctacggcctgaccgtcctgcgagtttttgtcggcatcattttcgccgctcatggcgcgcaaaagcttttcggcctgtttggcggttacggattggcagggacggcacagtggatggagagcatcggcctggcaccaggacacctgatggcgctgttggcgggcggtaccgagttcttcggcggtctggcgctgattatcggtctgttggcacgtcctgccgcgttggggttgagcttcaccttgctggtggcgattttctccgtgcacatcagcaatggcctgttcatggcgaacaatggttatgagttcgccctggctctgctcggtggcaccattgcggttctgatcgaaggcgcaggcaaattgtcactcgatgcggcgattgccaagtaacttccgggaaacacccaaggcccgcttgtagcgggcctttttcgttgctgatttcgttattggggattcttgacactaccccgtcggcttctctaggattgttgcccatgcgccgatttaaacagctacttgcggggcgccaggtgattcggaatatcaccgacagaagctctaccggcttcgaaataccgctaaagcgctggttcggtgttgcctctcacctgcccggcagaaaattgaggcagagacacgacacgatgaatgcacttcaccctcctgtacgtcttgcgccaatcacggcgaatcttgttcagcgcaatccaaaaattcttcttggcggcacacaccagccgacattgctgcgttatctcgatggctggccacgtcgtagcacaggcccttcggcctttctcattcagttcatcgaagacggcgagtccttggcacgttttgccaacgacagttttgatcttgcggtgatacaggcgcccagctcggaaaatgctgcggaagtcatccggcatctgacccgtgtggctcgacaggggctgatcacccgtaggtaagtaccgtaggtgatcaacccggcagtcgaggtgggggccgatgtttctgaattcctgctaaaggctgcatcgatatcaggggttcaaactacggagttgcgtttggccagctccgccagcgctaccagattggaaacgttgaaccgctttagcagcctgaccttataggtgctcaccgtcttgtggctgatcagcaacgcatccgcgattttctgattattcagaccgcttgccagcagtttcaggacggtaatttcccgatcggtcagttgggcaatcaagacgctttcctggcaggcggcgtttgtattctgttgcaaagtgctgattgtatcctcggggaaatagctataccccgagagtatggcttttaccgcattagccagttcgttcagattatcgttcttgcacagaaaaccagccgcaccggcctgcaaacagcgcaaggcgaagttcttggagttgctggaagtcagcaccagtgtctttatcggcagtccagcggatttgatatgggagataacggaaaacccgtccaggttgggtatgttcaagtccaggatgagcaggtccggaagatgcttgcgtaccaactggacagcgtccgcgccattatcggcttcggcgacgatgttgtgttcatgaggctccagaacggttcttattgcgagtcgaatcaacggatggtcgtcgacgatgatgatacttcccatgcaaggcatctcgatatttagggggagggtgcttttcgtattttatccgagcactctgaaaactaaatcagacgaatctgatagttgtcattgtgtggctaagttatggtttagccccgttttgatctggccaagccccccgctctctatgcgtattattatctttagaccgacctctcacctgaaaggctcttggttattcaacatgcttttacgtcttgatcgtgttatctactggttcgctccttctctgtctatgttaatgggggtggctggtatcgcgctgtgtttttttggctggcagcaacgactaatattgacaggaggggctggagtagtattgctactgttggcaggaggattaatcatgctatggtcgaattataattggtggttgttcaagctcagcccgcagagaggcttgaatattcctcttaagtgaggccgcagttgtcaatgctatcggtgatagtaggataaatcgaaagaattgagttttctggtagcgagttgtcggataattctacctggaaaataggagttatccagttgctggcatgtgttgttaggaggtactttttactccgtgctacatatttttagatgtataatggagtctaaaccggcgatgctgctacgaactatttccatcaaaaacgcagagcaggaagttctgaacggtgcggtgctctgcagttttgcaattcctatgctgagccgcaattttcttgcctatagcttaaatgagggtgctgaggtcggagagtcgcgagtttatttggcgatgctaaataaggcagggcagagttattcgctgagctcgatcgaggccgaagaagattggcgtcaggttattcaagtcttcaaggaaatagtcacccatgcgagcctgcctgaggggcgacagcaaggtgctggtggtagtactgatattccttaccatctgattgaccttaagaattgtgtgataccgacagggaatctatcggatcatcgttcactcaccatcaagaaaaatctggtgatgaagctcatctcgtcagaggcctcggttgtctgcctgcctgcaattgacagcgttgaactcggagttcctgcgctcgatgtctctatttccatggcttctcaagatactcctgcggcacaggctgtcgcggagcacatggatgaggtttctgattcgaatgagcatcgctcgccgggagccgttgaggatcttgaaggcgatgtattcgatggtgctccatccggatttgctccgattggagatccagaggaactctctcaaaagccaggaaaagttgagacggatatagagaaggttcttactgatgcttcattatttaccgagagttttcaatacgatatgactgaaatgccgactacgaatgccgaaaaacatgtcgactcatctgaaattgatgctcccttgtctgaccatttgacacctgaggttatcgctgacccgtctgccaactcggagaccgacattgggcgcctgtcccaaggtatacagaacacattggctggcttggcggaagtagttcgcgatttgtcttcggaggaaacggtgaagttgatccagagtgaagagtacgacctgtcgatatttgacagtgttccaactttgatggataggcaggttcaggctaccgcagatatcgatcaatccgctcaagttgctggggatgtaacaacggatgaggtggctgattgcccaattcccttagagagttcattggatgaaacgcagtttctgatggcgacgcttcctgaggctgaagctgcacttcagggggcggataccgatcacctacttcttgatgtggaaagcactttgtctaatcttgcacttatggcgcaggagttgacacagcaaaagttggtcgcggtgaaacaacaggaagctttggagcttttgaaggaacagttgcaagagcgagagcgtaaacttcatgaaaaagaagaacacctgcgccaggtacaaagtcagcttcagcaagagaaaatcacgatcgataagtctgctgagcataattcccgagtgattgcggaacgcagtgctgcgcttcaacagctggctgaaagtgtagagtccagagagcgaagtgttgcccggcgctctgaactaatgcagcttgagcagcaacgccttgatgaaatttccgctaagcaaagcatccgcgcagccgaactggaaaagagagacgccggaatccagcaaaaaaatacagagctagtggaaaggttagcgcagttgtccagcacccgtaagaagctcagcaatattgtaaaaggcttcaatgagacggtgaccttcaataacagcctgcatagcatatccagtacattgctcagcgatgatgagtaaagcgctcctgctagaattacagttctctttttcagtgtattgggtatttcaataaagccgtatttggcctgtgtgaaaaggcggaaaatacagtcagacggcgcaagctggagagaactgatggggtgtatccggttttagatatgtgcattctgatgtggattcgcacgtgggattgatgccccattgacctatcacgaccgctttttcgtacaagacccaagcggtagtgttatcggcctgttcactctggataggacatccccgtgaggaggtgtgctgcaggtggggctatctcgcttagcattggttctcaaggtctcgattcaaccataatgctgaactggctcataaggctctgcatgggggatttaaccaattgagtaccaagctcattacgcaggaaggtttcgaggctctgaaaaacgagctggattacctatggcgggagaagcgtccggatgtgacgcagaaagtcacttgggcggcctccctgggggatagaagtgaaaacgccgattatcaatacaacaagaagctcctgagggaaattgatcgccgggttcgctacttgcgcaagcgactcgaagacatgaaggtcgtgtcttattcgccggaacaggagggtcgggttttcttcggcgcctgggtcgatatcgagaatgaagagggtgaaaccaagcgtttccgtattgtcggttatgacgagatatacgggcagaaggattacatctctatcgattcgcccatggcccgggcgctcttgaagaaagaagtcggcgacgaggcgatagtgcagacgcccggtggagaaatgtgctggtggatcaatcagatcgaatacgtgaaatgaactgcctgcgaggggcttacctcgcgcagtactgtcagtgggctggcattcaatgcccggcgtgtcccgtagacaccggcaccgccgatcagcagggcaccgataacaggcagaagcaacagccagggatgtggatgccagggcaggtcgaaggcaaaccgatacagcaccaggctcaccagttccgatcccaatgcggccagtagcccgctgacggctcccagcagcccgaactcgatacgccgggccttgaccagtaattgtcgttccgcccccagcgcccgtagcagggcgccctgacgaatacgctcgtccagggtggcctgcagtccggaaaacagcacggccatgccggcggcgagtacaaacagcagcacgtattccacggccagggtgacctgggccaggatactgcgcagttgttcgagtagagcctccacttgcaggatggtcactgccggaaacgccctggacaactcgaccacctgctggtcatgacccgcagccagatagaagctggtcaggtaagtggcgggcagatcctgcagcgtgcccggctgaaagatcatgaagaagttgggctggaagttatcccagttgatttcccgcaggctggtcaccctggcctcgcgattgacccctgcgacgctgaatgtcatctggtcgccgagtttgagtttcaggctttcggccacctgggcctcgaccgagacgccaggcaaatccccttcgggctgttgtgcccaccacgaaccgctggtgatcttattgcccgctggcagatccgcggcccaggtcaggctcaaatcgcgctgcacggcgcgatcgccactggagtccttgctgacgatttcccggaccggttcgccgttgatgctgatcagccgccctggcactaccggatacagcggcgcggaaggggcggaaagcgccaccagcttgtcgatgaaagcttgtttgtccgcgggcaggatattcagcgcgaaatagttcggtgcgttctttggcaactggttttgccaggtgtcgagcaactctccacgtaacagcgcaatcaaggccatcgacagcagaatcaagccgaaggccagggattgcccggcagcagccaaaggatgccgcagcagctggcccagccccaggcgccatggcagcgacgccttggccagcaagcgacgcagactctgcagggccagcagcagtaatccgcccagaaccagggcggcaatgacgccgccgccgagcaaggcgaaggtcagcagcaaatccaggctcaggcgccacatgatcaggcccagggccagcaaggcggcgccatacaccatccaggtgcttggggggatcggcagcaggtcacggcgcaacacccgcaagggtgggacacgccccagcgccgccagtggcggcaaggcgaaaccgccaagtgccaccaggccggtgccgataccggcgacagcgggaagcagcccgccaggaggcacatcggttggtagcaggtcatgcagcaggtaaaacagcccaagctgggcgagccagccgagcagcgcgccgacgatgctggccaggatgccgagcagggccagttgcagggagaacaacagcatggtttcccggcgagacaggcccaggcagcgcagcagcgcgctggcgtcgaaacggcgggaagcgaagcgcgcagcagacagggcaaccgccacgcctgccagcagcaccgccaccaggctggccatgttcaagtagcgttcggccttgcccagggctccgccgatctggcggttgccatctcgggcatcctgcaggcgctgattggccgccaggcctggcttgatcaattggcgataggtttccagggcgctcccgggaccgcgccagagttccttgtaactgacccggctgcccggttgcaccacgccggtggcgttcaggtcgctcaggttgatcagcaccctgggggtcaggctatagaagtttccggcgcgatccggttcgtaagtcagtacccggctcaggcgtagggttttcatcccgacgtcgatgctgtcgccgattttcaggtcgagcgcggtcaacagtcgggcttcgacccaggcttcacccggttgcggaccaccgccggtttcttccgtcgcgtaaggggccggggcgcttttcagttcgccgcgcagcgggtaggcgtcgtccacggccttgatactggaaagctggatgccattatcggtggcgatcacactggagaactccaccacctgcgcatgttgcaggcccagttcccgaccgctctgtatctgttcgggccttgccggagagctgctttcaagcagcaggtccgcgccgagaaactccgtggcgcgcaacagcatcgcgccgttgaggcgcgcaccgaaatagccgatggcggtgctggcggctacggccaccaccagggcgaagaacaatacccgcagttctccggcgcgggcgtcgcgcagaagttggcgaacggcaaggctgaacaggcgcaacagcggcaggcgtgccatcaaggctccaggggggcgaccagtaggccggcttcaaggcggatcaggcgccggcaacgatgggccaggcgttcatcgtgagtgaccaggaccagagtcgtgccgctttccttgttcagatcgaacagcaggtcgctgatgcgctcgccggtgtggctgtcgaggttgccggtcggctcgtcggcgaacagcacgtcaggttcggcggcgaaggcgcgggcgatggccacccgctgttgttcgccgccggagagctggcgaggcgagtgactcaggcgttgcccgagcccgacgcgctggagcagttcggtcgcacgctcgcgggcatcccggcggccgtccagctccatgggcaacatgacgttctccagggcattgaggctgtcgagcagttggaacgactggaagacgaagcccacatgctcggcgcggattcgggcgcgctggtcttcgtccaaggtgctcaggctgcgaccggccagggtgacctcgccgctgctgggcaggtcgagtccggccagcaggccgagcagggtggattttccggagccggaactgccgacgatggccaggctgtcgcctttgttcagttccaggctgagttcgtgcaggatggtcagttcaccttccgcgctgggaaccactttgctaaggttccgcgcagtgagaatgcttgcgcccatggagaatccgatgcgtgtgtggtttttgagtgctggcctggccttgatgtgcatggcccagaacgcagcggcgggtacagtcctgatcgttggcgatagtatcagcgcggctttcggcctggatacccggcaggggtgggtggcactgctcgagcaacggctcaagagcgaaggtttcaacgataaagtggtcaatgcttccatcagtggagacaccagcgcaggtggccaggcgcggctgccggcgctgcttgcagagcacaagccagagctggtgattctcgagttgggcggcaacgatggcctgcgtgggcaacagcccacgcaattgcaacaaaatcttgcttcgatgatcgacagctccaaggccagtggtgccaaggtgctgttgcttggcatgcagctgccacccaattacggcgtgcgttatacccaggcgtttgccgaggtgtacagcaagctcgcgaatgaaaaaaatgtagcgctggtgccattttttctggaaggggtcggcggtaatcccgagctgatgcaggccgatggcatccaccctgcggtcaccgctcagggcaagttgctggaaaatgtctggccgacgctaaaaccgctgctttgacgcttttctaccggcagtgtttcggctaatgtggcgcccccgatttggagcccccgatgccgcgtcccgcctggtccctgtttgcctaccaactgatcgagcctgacgaacagctcgacctgttcgcctgccaggaagtccgggtgcacctggtgacgcgtcagctggagctgggcggctctgccgatcgcacgttgtgcggcaccttgctgcccgcgcaaccgcgctggtcgagtgtcgaccggaccattttccaggaccagcgcctgtgtccgttgtgccgggcgatcctcgaatcgcaaaagcgcggtacgccaccgatctggccagagttgcgtttcgaactgtaaggcagcaagttctcgcccggctccctccttgctgatgcagctgtcgctcccgcagtcacgggggcgggtgtacaatcactttttttactcgttgatcatgcgaaggattttccggatgttgccgcgctttcctgtcgtcacccgttgcctgacgcttgccgccttctgtgtggccggccccgttgccgcattggaactgcctctacctccaccgggcgaagatatcgtcggtcaggtacaggtgatcaaggccaagtacgaagacacctttgccgacctgggcacaacctacgacctgggctattacgagatggtcgcggccaacccgggagtggatccctggttgccgggcgcgggcaccgaagtggtgttgccgacgcgtttcatcctgccgccgggacctcgtgaaggcatcgtgatcaacctggctgaatatcgcctgtactactacccgaaagggcggaacgtggtgtacaccttccccctgggtatcgggcgggaaggttgggggtcgccgatcgcccataccagcattgtcgcgaagacgccgaacccgacctggactccgccagcctcgatcaaggccgagcacgccgccgacggtgacccgctgccaaacgtggtgccggcggggccggacaacccgttgggaccattcaagttcaccctgggcacgccgggctacctgatccacggttcgaacaagaagttcgggatcggcatgcgcaccagccacggctgcttccggatgttcaacaacaacgtcctggaaatggcgagcatggtgccggtggggacatcggtgcgcatcctcaacgatccgtacaagttcggtatcagcgctggcaaagtttatctggaggctcatacgccactggatgacaagggcaatccgtcggtcgtggacaagcacaccgcggtgatcaacgccttgctcaagcgtgaagacctggccaataacctgcggatgaattgggatgtagtgcgcgacgtggtggcggccgaagatggtttgccagtagagatcgccataccgaccaatgcaccggtggtatcggcggtgcctatcgatatgcagcagtaacggctggaacagcaacccgtcgatgctttcgggcgtcgacgggttttttattgccacaagaagatccgggcaataaaaaagccgacccaataaatgggtcggctcgataacaatcccgagggattattacttgcggctagctttttccagcatacgcagagcgcgctcgttagcttcgtcagcagtctgttgtgctttttgagcagcagccagagcttcatcagctttacggtaggcttcgtctgcacgagcctgggcacgagctgctgcgtcttcagttgcagtcagacgagcttcggtttctttggatacgctgctgcaaccggtagccagaactgcggccagagccagagcagagaatttcagaacgttgttcatcgtgttccccttcaaggactttctattaagtagctatctcatccgagtgatgaaatggccggcgtacatactacccattacttgtagtaagtaaactgacgtagcgcaagaagcaaaaaaaattctaggcgttgaatctttttcgagcaactttttatcgatctgtataaaaaatacgcaaccttgtcaccctgttgggaggttgcgcttgttaaccgtatctgccgtagagtccctttgcacggcgcttgcggagtgtaggctcaagtctatctatatcgactcgtctacacttttgttcagaatctgtggggcgcctcacgcatctttgtccatgttgaggtgactttaaatgggtgggctcgtcttaaatctcaacatccggcgatgttcaggttgttgatcctcaggcggtttgatcgagcgttttgcatgtagctgggaacaggtccggggaagtatcgacagcaaactggcctgatgccagtatcttgaacacaagcgcccttgagcattggtgccaatggtgcctactatttgaaacgtgctcggtcatgcgagagcggcaagctctcctcggtgtccagacaggcacggggtggcgtagttgttccttcgccggaaaaacatcggtaaggtaggggtcagaatccaagacccgcgaggagtagtgatgagcgaggcgttgtccatccaccatgaccaggctggtcatcaattcgagaccaatgtggacggtcaccgtgcctacctgacctatatggacctgggtaagcagaccctggatatttatcggacgttcgtgcctaacgcgctgcgtggccgtggtattgccgcggcactgaccgagcaggcgttggaatatgctgaccgcatgggttacacggtaattccgtcgtgctcatatgtggagcgctatatggagcgccatcagcgccacgccgcgaaactctgagcggggacgccaaaaaaaacgccgggcttggcccggcgtttttgtgtctgcgatacggggtcaggtacgaacccgttttggcaggacatccttgagcttggcatgcatgctgcgcaaggttttttcggtgctttcccagtcgatgcaggcatcggtgatcgacacgccgtattgcagttcggccaggtccttgggaattgcctggcagccccagttcagatggctttcgaccatcaggccgatgatcgactggttgccttcgagaatctggttggccacgttctccatcaccagcggctgcaaggctgggtccttgttggagttggcgtgactgcagtcgaccatgatgttcggcttgatctttgccttgttcagcgcctgctcgcagagggcgacgctgaccgaatcatagttcggcttgccattgccgccgcgcagaaccacgtgaccgtaggcattgcccttggtggtgacgatggagacgccgccttcctggttgatgccgaggaagcggtgagggctggaaaccgattgcagggcgttgatggcaacggtcaggccgccgtcggtgccattcttgaaacctactgccgaggacaggccggaagccatctcgcggtgggtctgggattcggtggtacgtgcaccaatcgccgaccaactgatcaggtcctgcaggtattgcggggagatcgggtccagcgcttcggtggcggtcggcaagcccatctcggccaggtccagcagcaactggcgtccgatgtgcaggccgtcctggatcttgaacgagtcgtccaggtacgggtcgttgatcaagcctttccagccgacggtagtccgtggtttctcgaagtacacgcgcatcaccagataaagggtgtcggagacttcggcggccaggactttcaggcgctcggcatactcgtgagcagccttgatgtcgtggatcgagcacgggccgatgacgacgaacaggcggtggtcggtgccgtcgagaatattgcggatcacttcgcgacccttggtcacggtgcgcagggcggcgtcgctcagcggaatgtcacgcttgagctggtcgggagtgatcagggtttcgttggaggcgacgttaaggtcgttgatcggtaaatcagccatcgtgttactcgtcaggtcacgggtgccggccgccagcgatccccgcgcggcggtgcacagcggatttaagcgcgtcggggagccgaaccttagcgcgttacaccggggctcgacaatgggcagaggcgggtttaatccagcgctggctgcataaaagcctggtgaacccggtcatgggagaattcggcggcgtgctgttcgacccattgctgggccagggtttcgatctgtcgctgctcagcctggggctcatgcaggtggcaatagtgggcgatctggcacacctgctcactcattcgggcatggaacagggtctgttcgtcgatgaaggcgatccccaccagatagccatgcttgcgtcgcaggcaccaggccacatagccgttgtagcgggcgttttcacccagagtggggatgcagatttccagtgcggtgccgcaacgccaggcgcggtgataattgcaagccatgccgccgaggctgatagtgtgcaaccgttgacgcgaaatgcatgcgtgctcgcgtaaggtcatctcaaccggaacatcgtcaggatgaggaatgaaacgtcccatgaacgcagactccgagtgtcggctatgtgacattgtttcccccagtatagtggtcgaattggagctgactgatttcgatatcgatcagcggttgttggcgatgagcggtgtttcgctggtgatattcaccagcgccggctgcgccagctgtcgctgggcccggcagcagttgcccggcttcgatctgccgatcgagcggttgtgctggatcgatgcgggaaacaatggcggcgcggtcgagcgttatcaggtgtttcacttgccggcactgttcgtggtgcgcgacggtgagttttacggggccttacagtcgcgcctgacacctggctcgctccgcgagcgactggcacaggcgctgaaccgaattccagaggagttgccttgatggaagcagtccacacgccgcgaatcggcattatcggtaccggggcgatcggtggtttctacgggatgctgctggcgcgagtcggcctggatgtgcatttcctgctgcgcagcgaattcgccgcggtcaccgagcgggggttgcaactgcatagcgcggtgcatggtgagctgaccctgaacccggtccaggcctatgccagtgccgaagacatgccgccctgcgattggttgctggtgggagccaagaccaccagcaacgccgagctggctccggcgattcttcgcgcggcggctcccggcgccaaggtgctgttgctgcagaatggcctggatgtggaggacggcctgcgcgacctgcttcccgactcgctgcatctgttgggcggcctgtgttttatctgcgtgcaccgtgccggccccggggtgatcgagcatcaggcgctgggcgcggtgaacctgggttatcacagtggcccggcagcgcaggacgactcgcagcgccaggcgatagtggaagagggggctgcgctgttccgcaaggccggtatcggctcccaggccatggccaacctgcagcaggcgcgctggcagaaactggtgtggaacgtgccctataacggtttgtcggtattgctcaacgccagcaccacgccgctgatggccgatgccgacagccgcgagctgattcaggccttgatgcgtgaagtggtgcaaggcgccctggcctgtggtcacatcatgccggacggctatgctgagcacttgttcaaggtgaccgaaggcatgccggactattggccgagcatgtaccacgactaccagcacaagcgtgcgctggagttgtcggccatctatgccgcgccactggccgcggccaaggcggtgggatgcgcactgccgaaaatggaagccttgtatcaggcgttgagttttatcgaccggcataacggttgatcgcagcatcgaggggaggggatatggcaaagggcttgggcggtaaactggtggtggcgatttcatcgcgggccctgttcgatctcagcgagagccataaggtctatctggccgagggggtcgaggcctaccgcaagtatcagatcgatcacgaggaggaatccctcgaaccgggcgatgctttccccctggtgaaaaagctcttgagcctcaatgccagcctcggccgggcgcgggtcgaggtggtgctggtttcgcgtaacagtgccgacacgggcctgcgggtcttcaactcgattcagcattacggcctggatatttcccgggccgcgtttgttggtggccgcagcccttatccctacctcgcggcctttggttgcgacctgtttctttccacccatgccgaagatgtgcgcagcgcactggacgccgggttcgccgcggcgaccattctttccggtggcgcccgacgcgccgccagcgccgaactgcggatcgctttcgacggtgacgccgtgctgttttccgatgagtcggaacgggtctatcagctcggtggcctggaagcctttcaggccaaggaacgcgagtccgcccgcgagccgttgcgtggggggccgttcaaaggcttcctcgccgcgctcaatctgttgcagcgcgaattccccgacgatggttgtccgatccgcaccgccctggtgacggcgcgttcggcaccggcccatgagcgagtgatccgcaccttgcgcgaatgggatatccgcctggacgaatcgttgttcctgggcggcctggagaaggccgcctttctcgaagccttcgccgccgatgtgttcttcgacgatcaggcgggtcattgcgaactggctcgcgaagtggtcgccaccggtcacgtaccccacggtatcagcaacgaaaccaaggtttagctcaatgttcacgggcttgcgcgggacgtcgtagtcgccttggcactgctaagctgaatcaatctccgccatattggcagtcgaggaggtcatatgattcgttcgatgctgtatgccactgacctcggtctgtatgcgccctacgtgatgcaacatgccctggagctggctcgaacattcaatgccgaattgcacgtggttcatgcggtggagcccatggggctgtttgccgagtcggtgttgcagagttatctcgacgaacaggccctgaatgagtttcacagtcagggtctgagcacggtgatggcgaatatcgagcaacgggtgctcgacagctttcgcgaagagttgggggagggcatgcaggatctcgcgctgattcagtcggtcagggtctttcagggggacccctcgcacgtcattctcgagcaggcgtcgaaactctctgtggatttgttgatcgtaggaagtcacagccatggggcgggcggtgaaactccattgggcaggacggcagccagagtactgcaactggccaaggttccggtttacctggtgcccttggtacagcgtcggcggctcggagatatctgacgcggttattggaattttcttaataaaagttctagatttattcttcgaaccattaatatagttatataccgtcgctgatgcccgtggcgtctacctgctttgagggattcatatgaagcttcaacaattgcgctacatctgggaagtggcgcaccacgacctcaacgtttccgctacagcccaaagcctttatacgtcgcagccgggtatcagcaagcagatccgcctgctcgaggacgagctgggggtcgaggtattcgctcgcagcggcaagcacctgactcgcgtcaccccggctggcgaacgcatcatcaccaccgccggcgagatcctgcgcaaggtcgaaagcatcaagcagatcgcccaggaattctccaacgagaagaaaggcaccctgtcgatcgccaccacccatacccaggcccgttatgccttgccgccggtgatcagcagctttatcaagcagtacccggatgtggcgttgcacatgcatcagggctcgccgatgcagatcgccgaaatggctgccgatggcaccgtcgacttcgccatcgccaccgaagcgctggagctgttcggcgatctggtgatgatgccgtgctaccgctggaaccgttgcgtagtggtaccgcagggccacccgctgaccaagctgccgaagctgaccctggaaaccctcgccgaatacccgatcgtgacttatgtgttcggttttaccggccgctccaagctcgacgaagccttcagccatcgcggcctgacgccgaaggtggtgttcaccgccgccgacgccgacgtgatcaagacttacgtacgcctgggcctgggtgtgggcatcgttgccaagatggcggtcgataccaagcttgatagcgatctggtggtactggatgccagcgaactgttcgagtcgagcatcaccaagatcgggttccgtcgtggcactttcctgcgtggcttcatgtgcgacttcatcgagaagttcgcgccgcacctgacgcgcgaagtgatggccaaggccattcagtgccacaacaagcaggagctcgaagagctgttcgacggcgtcgaactgcctgtccactaagtcgggcttacttgacctcggtgacagcgaactgttgccgagcgcccgcgacgacgatctccagttcatccccctcgaacttgcccagcaggcctttgcccagcggtgaacgaggggtgatgacggtcaccggttgccccaccacctctaccttcagtcccgccccatccggcgccaggaacagccattgttcgtggccgttttcgtcttcgaggcccagcagcgcgccgacctggataccaacctgctcgtcgtacgggcgcagggtcaggttctggcagagcgccagcgcctgccggatttcctcgacgcgcctggcctggccggcggcgagataggaggcctcgagccccagggtgtcgtatttgttttcggcaatgttctcttcgtgggtcgccgcctcataggcggtctgcgccgcacgctgggcgatctccagatcgccacggagtttgtcgagaatcagctggtggaccgtagacttgttcatgatcaatcgcagaattgcaggacgttggcccggctcttttcgctcggcgccgtctggtcctgttgcaaccagaactggcatttcgggttggattggttgcgcaggttgctgcgcgcattatccagggcctgctgctgttcgtttttacgcaggttttcctggtactgctcgaacatgcggttggacgctgccgattccgcactgggcggttttgccagctgttgcacggcctgggcgacgggcgccaatggctggtcgaacagaaaacgccaggccagccagcaggtcagggcgatcgccagaaaacccagccacaatcccagggcaatactgccgctgagttgaagtgcgtttacgctaatacgtaatgatcgacggggtgtcgggcgatagggcatggcagcctcctggcaggcggtgtcggcaagctgcgattgtcgcacgaagattatcggcgttggctcttctgtctgtgaccatttatgcggacaatcggcgcctttgccaaatggagcccggaatgaaagcctcctgggatattttctgcagcgtcgtcgacaactacggcgatatcggtgtgacctggcggctggcccggcaactggtggccgagcatcagtgcgcggtgcggctgtgggtggatgacctgcgggccttcgagcgtttgtgtccgcccatcgatatcgccttgcctcagcaatggcaggaaggcgtcgatgtgcgtcactggccaaccgagtggtcgccggtgacggctgccgatgtggtgatcgcggcctttgcctgccagttgccggcggcttatatggaggcgatggccgaacgtaaacatacccctttgtggctgaacctcgattacctcagcgccgaggcctgggtgaccggctgccacggtctgccctcggtgaagttcaagggcgtgcagaagtacttctttttccccggcttccaagccggcaccggtgggctgctacgtgaggctggattgctggagcggcgcagggaatttcagcaggaccccctggcccggcaacgcttcctggaagggctcggcgtatttgctgcacctggcgcgcgattgatgtcgctgttcgcctatgagaacgccggcctggccagttggctgcaagtgctggctgccgactcgcgggctacccatctactggttcccgaggggcggatcctcggtgacgtacaacgctggctgggtgtcgaggcgctggcggcgggtgcggtgcaggtccgtggggccttgacggtacaggtgctgccgttcgtccgacaggaggaatacgaccagctcctgtggtcctgcgatttcaacgcggtacgcggcgaggactcgttcgtgcgcgcgcagtgggccggccggccgatgctctggcacatttatcaacaggacgaagacattcatctggataagctcgacgcctttctcgagctttatacgcgggggctgtcaccagaggccaaggcggcgctgatcgacctgtggcgggcctggaatgccggaggcgagatgacacaaggctggaaaaagctgctcgaacactggccggaagtggctgctcacgccgaaaagtggtgtctggaacagggctcgcagcccgatcttgctgcggcgctggtgcagttttacctaaatcagggtgggcactgagaggacccaatgaacacgggacgaaaccctctatgcgcaccaagaccacaccaagcctgttacaaaccatccttgcccgtccctatctgtataggcgtaatggggtctatgtagtggtcaactaatcccggacacgacgttaagttttttctcggcccgagctggcgctagtccgccgttgaattggtgtggtcgaatccagttgtaccgatgcatcaaataatggctgatgtcccggtgcgcttcttgggttgtcatgtagccctcagtcggtatccattcagttttcaggctgcgaaacacgcgttccatcggcgcattatcccagcagtttccccggcggctcatgctctggcgcatgcggtaacgccagagccgttggcgaaactgacggcttccatattgcgacccctgatccgagtggaacagcaggccttgaggcctgccacgctgttcgtaagccatgtccaacgccttgataaccagatccgcatccggcttgttcgacagcgcccaacccacaattcgacgcgcgtagagatctagaacgaccgccaggtaatgccatttcccctgcgcccagatgtaggtgatgtcgccacaccagacctgattgggtaccgatacctcaaactcccggttcagggtgttcggaatatcaggacgctcgaccgtcgcttgtttataggcatgtgagccaggttgtttgctgactagttccagttctcgcatcaagccacgtaccttgaaccgcccgatttgctcgccatcttcctgcatcatcgacacgatactgcggctgccggcagcgctgcgactttgcgtgaacagttcgttgactcgactgcgtaatcgaagtcgttcaacgttcggagttcgacgtctgaggcggtgggcgtagtagcacgaacgagtgatttcaaagactgtgcaaagccaatcaaccggctcttgtgcactcaactgatcaatcagcgcgtgcgctcgtgttcttccgacatcaagagcgccgtagccttttttaaaatggatttctcccgctcaaggcgagcaattcgagcttccagttcctggattttttgctgttcaggcgtcagcgccttgctctgcggagtaacgccggtgcgctcctgctgaagctgattaacccagcgacgcaacgcggactcgacaaccccgagtgaacggcaggcttcgatatggctatagccttgatcgagcacgaggcctgcggcctcgcgtttgaactcagcggaaaaggaacgacgttgcttggtcatcagacacctctatctggcgagcattctcgcctaaatgggtgtccggtttcattagaccactacaaagtatcaaaggggagggctgtaggaagattctgaactttgctggagcccttcgagaatctggcagaaaaatctgaatgaccacctcaatacgcatatgtgcccaggctcccccgtgggggtccttatcgcggacctgcgcgcctctggatgaaacgtcacaactgagcgccaagggttcaccaaggccacaccaagccttgccccaagggcgttacaaggaactttaccgggcccaatgatcccgctacgatggccgcccagctctttcattgcccagttttacctaaattggatatgatacgcggcctagatttttgtaaatcccatccaaattcggatattcgcaatgaaaactggtaaagaactcaaacccggtaccgtgatccgtatcgacaacgatccttggctggttcagaaagctgaattcaccaagtccggtcgtaacagcgcgatcatgaagaccaagctgaagaacctgctgaccggttacaagaccgaaaccgtttacggtgcggacgacaaactggacgacgtgatcctggatcgcaaagaagcgaccctgtcgttcatcagcggcgacacctacacgttcatggacaccaccgactacaccatgtacgagctgaacgctgaagacatcgaagctgttctgccgttcatcgaagaaggcatgaccgacgtttgcgaagccgtgttcttcgaagaccgtctggtttccgttgacctgccgaccaccatcgtgcgccaggttgactacaccgaaggttccgctcgcggtgacacttccggcaaggtgatgaagcctgccaaactgaagaacggtaccgagctgtcggttgctgacttcatcgaaatcggcgacatgatcgagatcgatactcgcgaaggcggttcctacaaaggccgcgccaaggtttaagcactgcttgaatccttagccacaaaaagcccgaccatcgagtcgggcttttttgtggctgaaggtccgggtggcaaacttacttcaggtgttgcttgagctcttcgctggcctgcagcagggccgaacgcaccgcgggtacctggctgaccacgttgagcaggccgtagtcgtggatcatcccgttgtagcgcaccgaggtcacggtcacgccggcttcgtccagcttgcgggcataggcttcgccttcgtcgcgcagtacgtcggcgccggccgtctggaccagcgcgggtggcaggcccttgagctgggcgctggtggcgcgcagcggtgaagcgtagatctcgttacgctgccgggcatcggtggtgtagttgtcccagaaccacttcatcatgtttttgctgaggaagtgtccctcggcatactggttgtatgacgccgtttcgaaattcgcgtcggttaccggccacaacaacagctggaaccggatcgccggcgtgcccttgtccttggccatcaggctgaccactgctgccatattgccgccgacgctgttgccggcaaccgccaggcgcttgccgtcgacgttgatttcctggccatgctcggccacccagcgagtggcggcgtaagcctgattgatcgccaccgggtaacgcgcctccggagacggcgtgtaattgacgaacaccgccgccgctccggagcccaccaccaggtcccgcaccagccgttcgtgggtcgggaagtctcccagcacccagccgccgccgtggaaaaacatgaacactggcaacgtgcctttcaccccggccggcctgacgatggtcaggctgatggcctggccgtcgacgtcgatggtcttctggctgatatccgccttgggcagcgtcagcttgaccccggcctgggcaccgaccagcacggcccgggcctctttgggggtcatctgttccatcggcttgccgccgccggcgttcaaggcgtcgaggaacgcctgggtgttgtgttcgaccccgccttcggcgaacgccgtgttgatggacagggcgagaaggctgccggtcaagaccttgctgaaagtgttcatgttcgtctcctgggcggtgcgggcgctggcgcgcagctgggttagacagtcacgtgcagacgtacgtcgacgttgccgcgggtggcgttggagtaagggcagacctggtgagccgcttcgaccagggactgcgcgtcgctctgttcaagacctggcaggctgatatgcaggtcgatatccaggccgaagccgccaggaatctggccgatgccgacgtgcgcagtgatcgaagcgttgtccgggatcttgcgcttgctttggctggcgacgaatttcagggcgccgataaagcaggcggagtagccggcggcgaagagttgctcagggttggtcgcctggccgccggcaccaccgagttctttgggggtggagagtttgacgtcgaggatgttgtcgctggagacggcgcgaccatcacggccaccggttgcggttgcgactgcggtatagagagtttgcatggtgtgagcctcttgggtttcgaatttttgcgctaaatgtttgcgcgctaagtaagtgcgaaataaatgtatcgctcaaatattttgtgcgcaagataaatttttgaaaaaaactcgaaaatgcttgccagcagtccatattttttggctaagcgaatgatttaaataatatttttatcgataaattttttcgtcgatacgctgttagcgacatcgaaacagagagaatcgcgagcaagcgctcctgcagaagggcagggcgtgctcgcgagcgcgccgttaaaggctgtcttgcagatggccgcgcaggttcagcaggtcggcctgcagtttgcgcagttgctccagggtcaggccgctggagccgaggatgcattggggaatgcctcgcgcccggtcatacagggcccggccttgatcggtcagctcgatgatcaccacccgttcgtcttcgcggctgcgggtccggctcagcaatccctcggcttccaggcgcttgagcaagggcgtcaatgaaccgggatcggtcagcaggcgactgctgatctcgccgacggtcaggccatcctgctcccagagcaccatcattgccaggtactggggatacgtcaggcccagctcctgcagcagtggtttatagactttggtcatcagcaacgaagtcgagtgaagggcgaaacacagctggttatccagcagcagatcgtcgcatttttccggggtggagcctttggtgttcatggtcgggccttgatcgatactcgccctgaatctagcgggcgaatctttaatgcgccagataattctcacgagtgctcagcccatggcgctctgcagggccagatcccagggcggaatcggactgaagcgagtcttcaggtattccagcaacaggcggctgcgagcgttggtgtgctgttccaggcgcaaggcgtagataccggcgctttccggtttgggcaggccggtttcgcagaacagcggcaacagttccccacgcagcaggtattcgctggccagccaggtcggcaggtgggcgatgcccagcccggccagggctccggatagcagggcctcggcattgttggcgctcatgcggatgcgttgtgggcgatgagtctgcaactgcccgtccagttcgaagcgccaggcgaacagtggggccaggccgtcccagtccaggccatcgtgctggctcagttcggcgggatgcaccggggtgccgcgcagcttgaggtaggccgggctggcgcaggcgatgcgcacgatgctcgccagtgaggttgccaccatgcgggtatcgactctttgcccggcgcgcagcaccagatcgaccttgcccaggtgcgagccctgcatgtcgacgaagctgtcgatcaggtgcaactgcacatccagccccggatagagcatcaggaaatcggcgatcgctggcgccaggtgtcgccggccgaacgccgcgggagcgtcgatgcggatcaggccttccggcgcgtggctcaaggacacggcttccgcccgggccagttgcagttcggcgacgatgcgccgggcgcgttcggcaaaggcctggccagccgccgtcgccaccaccgcgtgggtggtgcgcatgaacagcttgctgccgaccgcgctttccaggctgtcgatacgccgggccaccgccgaaggggtcaagggatgccggcgcgcggcggcggaaaaactcccggcttccagcacatcgaggaacaggccgagctggtcggtgaggacgttggggttcatggtgggtatttgcttgtgcgaatttggcaaagccattgtgcgttgctgtgcgtttccgcaccagagccgactgcgtagcatgcaaggcttgagtgaggagagcggcggtgatcgatttagcgatgtatgtggtattgggcgcggcgctgggcacggtgggcggcttgttcgggatcggtggagggctgattgcgattccggtgctgggtgtgctgttcgggctggaccagcagatcgcccaaggcacggcgttggtgatggtggtgccgaacgtgatgctcgcgctgtggcgttatcaccagcgcaaccggatcgaggcacggcatgcgctgccattggccttgatgggcttctgttttgcctggctcggttcgatctgggcggtgggcatcgatgcccaggtcatgcgggttggcttcgttgcgttcctggtggccttgtcggcctacaacctgttgcgcatgttcctggccaatgccccggcttcggcgcagatgcgctatccctggccgtggctcggtgtgctgggtgcggcttccggggccatgggcgggttgttcggcgtcggcggcgcggtggttgccaccccggtgctgaccagcgtgttcggcaccacgcaggtggtcgcccaagggctgtcgctggccctggccctgcctagcaccggggtgaccctggtgacctacggggtgcatcaggaggtggactggatgatcggcctgccgctggcggcgggtgggctgctgagcatcagttggggggtgaaaatcgcccacgcactgcccgagcgcatgctgcgcgggctgttctgcggcttcctggtgatctgcgcggtgatgctcgcctttaaagtttgaagccttcgactatgtgctcggccaggcattcggtgatgggcgaaggcgtgttgaggttgcgcaccagcatgatgctggcctcgggcagcaggggcagatcttcggcggcgcccagaatgcgcatgtccggggtgatcaggctttccagctgcgcggtgatcgccaggccggcgctgaccacggccatcagtgccgacaggctggagctgttataggcgatgcgatagtcgcggccggcggcgtccagcgcattgcaggcccactgcctgcagaagcaatcgctgttgaacatcgccaggggcagcggcgtctgttcgtgggggcagaacccctgggcctcggcccagacgaaacgctccttgcgcagcaactggccgatttcgctgcccggctcgcgggtgacgatagacaggtccagatcctggcgcagcagcagttgcttggacgattcgcaatgcacctcgatctggatcaagggataggcctgggcaaagcgcgacaggatccccggtagaaagcgcatcacgtaatcgtccggcgtaccgatgcgcacggtgccgaccatgtgcggctcgcgcagggtgttgaacacctcgctgtgcagtttcaggatgcgccgtgcgtaacccagcagcacctggccttcggcggtcaggcgtacctgccggccctcacgctggaacaactggcgttgcaacacgtcttcctcgagccgcttcatctgcatgctcaccgcggactgggtgcgattgacctgctccccggccttggtgaaaccgccctggtcggcgatggcgacgaaggtgcgcaggacctcggtatcaatgcttgggtagctggacaattcatcaaactccgagatgtattgtataagaaacattcgttggattgatcttagccctgggtggagacttgagccatccccactggagggcaagacgatgaaaggtcaaaaaggttttgtattggctcacaggttggcatggcatggcgtttccttgcggcacctgctgcagaggattgtccgctggcatgagctgcactgtgaacgcaacatgctggccggcatgagtgacgaggcgctgaaggatatcggcctcagtcgcgcggatgtggagcgggagaccgtgcggccgttctgggacgatccgatgcacaagtgaatgtcaaagcgctacacaagccacttctcactgaggtagtttgcgggcagacaaggagattgccatgcccgcagaactgtccttttccctcaagcaggctcggcgtctggcgctggccgcccagggtttttccgggcggccagcgcctgcgacgatcaggcccgcacagctcaatcgcctgatcgcgcgcctgggtatcctgcagatcgattcggtcaacgccctggtgcgctcgcactacctgccgctgttttcccgtcttggcgactatcccgcgcgactgctggaccaggctgcctggagccagggacggcaacgcacgctgttcgaatactggggccacgaagcctcgttgctgccgctgtcgctgtacccgctgatgcgctggcgcatgcagcgggccagccaggggcaggggatctaccagcagttggcgcgttttggccaggggcagcaggcgactatccgccgggtgctggccgcggtcgaggagcagggcgccctcggggccggcagcctgtcgacccgcgaggagcgcgccggcccctggtgggactggagtgcggagaagcacgcgctggaatggctgttcgctgccggtgaggtgacggtcgctggccggcgtgggttcgagcgcttgtacgacttgccggagcgggtgattccttcgagcatcctgcagcattcgccgctcagcgaggccgacgcccagcgcggtttgctgctgcatgccgccagcgccctgggcgtggccaccgagaaggatctgcgcgactactttcgcctggagccggcagacagccgggcgcgcctggcggaattgctggaaggcggcgaactgctggcctgcgaggtggcgggctggaagcaagcggcgtattgcctgccagaggccaaggtgccgcgcagcgtgccggccagcgccttgctttctcccttcgattcgctgatctgggaacgcagtcgtaccgagcgcctgttcgatttccgctatcgcctggagatctacaccccacagcacaaacgggtgtacggctattacgtgctgccgtttctgcaccacgaacggatcgccgcgcgggtcgacctgcgggcagaaagggcgcaggggcgcctggcggtgcatgccgtgcatgaggaggatcaggggctggacgagcaggggatgcaggcgctggcgagcagcttgcggagcatggccgactggctggggctggccgacgtccagctcaattgcccaagggccagcgcccagcgcttgcgcgtgtttctttgaccagcatcgatcatccagcagcgtgccctggatgatcgagcactacgggttcaacgcttgacctgtttcaaggtctcggcaatcaggaacgccagctccagcgactgatcggcgttcatccgtgggtcgcaatgggtgtggtagcgatccgacaaagcatcttcggtaatcggccgcgcgccaccgatgcactcggtgacgttctgcccggtcatctcgatgtggataccgccggcataactgccctcggcttcgtggacctggaagaactgcttcacctcattgaggatctgcgcgaaatcgcgggtcttgtaaccgctgctggccttgatggtgttgccatgcatcgggtcggaactccacagcaccttcttgccttcgccttccaccgcgcggatcagctgcggcaggtggtcgccgaccttgttcacacccatgcgcacgatcaggttcaggcggcccggatcgttgtccgggttgaggatgtcgatcaggcggatcagctcctcggtgttcatgctcgggcccaccttgaccccgatcgggttattcaccccgcgcaggaattcgacgtgggcgccgtcgagctggcgggtgcgatcgccgatccacagcatgtgcgccgagcagtcgtaatagtcgttggtcaggctgtcgcgacggacgaaggcttcctcatagttcagcagcagcgcctcgtgggcggtgaagaagctggtctcgcgcagttgcggcgagctgtccatgccgcaggcgcgcatgaaggccagggtttcgtcgatgcggtcggccagctggctgtacttctcggccagggcggagttggcgatgaagtccaggttccatttgtgcacctggtgcaggtcggcaaaaccgccctgggcaaaggcgcgcagcaggttcagggtggcggtggcctggtgataggactgcagcaggcggtccgggtccggcacccggctttttgcatcgaaaccgatgccgttgacgatatcgccgcggtaggccggcagggtcacgccattgatggtttcgtcattggccgagcgcggcttggcgaactggccggccatacgcccgaccttgaccaccgggcaaccggcggcgaaggtcatgacgatcgccatctgcagcaggaccttgaaggtgtcgcggatcttcgccgccgagaactcggcgaagctctcggcgcaatcaccgccctgcagcagaaaggcacggccctgggtcacttcggcaaactggcggcgcaactcccgggcttcgccggcaaacaccagcggcgggtagctggccagggtctgctcgacctgcaacaggtgtgcggcgtcggggtagacgggttgttgctggatcggcagggcgcgccagctgtcagggctccagggttggctcatcacggactcgggtgtttttaaggtcggacaggcatgttatcagcaattagtgcgtgacctgttcccgccggttcgcggacaatcgcgcctttcccgctcggcgccgagcggccggtttatcgcgacggcgaggttgagccccgtcgcggctaggagaagagatgactgaggagcgcgtcgagcgcctgctcgccgaagtgcacgatgagttcggcatgattcgggtactggaagtggcggattaccgcttcctcgaatttggcgatgccattgagcagagctgcgtgtttaccgccgacccgagctggctggagtacgactacacccgcgccatgctgatcggcgcgctgtgccatgagcagcccgagagcgcgctgtttctcggtctgggcgccggcaccctgactcaggcctgcctcaagttcctgccgctggacgatgtcgaggccatcgagctgcgccccgacgtgccgcgcctggctatcgagtacctggggctggatgacgatccgcgtctgtatatccgggtcggcgatgcgctcgaactgctggacagcgccgagtcggcggacctgattttcgtcgacctgtacaccgatgtcgggccgggcgtcgggcacctggcctggggtttcctggaaaactgccagaagcgcctcaacccgggcggctggctggtgatcaaccagtgggccaccgacgatggcaagccactcggtgcagccttgctgcgcgggctttaccaccggcattactgggagctgccggtgaaggagggcaacgtgattctgatcgtgccgtccgacctggagcaggggctggacatggacggcctgagcgcccgggccgaggcgctggcgccacgcctgggctattcgttgcagccgttgatcaagtgcatccggccggcgacctgagtcggctggtcgagcgtatctgtaggcgcgaggcttgcctgcgatagggcctcgcattcaccacgggttcagaccgctcaacatcccttgaacacccccgggcgcttctcgaccatcgctcgcacaccctccttggcgtcctcgctgttcaacagcgccttcaccagcggcggcagcccctgcgctgccgcgctttctccttcgagccgggcttgtcgggccgacatcagggtcgcctgaacccccagcggcgcctgacaggcgatccgttcggcaagggccagggcgcggggcagcaggtcttcgctggccatcacctcctgcaccagccccaggcgcagggcttcatgggcgtcgaattcgtcgccggtgagcaaccagcgcatggcattgccccagccggcgatctgatgcaggcgcagggtggcgccgccaaagggaaaaatgccgcgttgcacttccaactgggcgaagcgggtattgctggcgcacaggttgatatccgccgccagcatcagctcgatgcctatggtcaggcagtagccctgcaccgcgactatcaccggtttgctgacccgcggcccggcgaagacaccccagggatcgcaaccgccggccggtgcctgccagccttcggcgagtttcgccccgacgttggccaggtccagccccgcggtgaagtgctcgccatggccgaacaccacggcgacccgggcctcgctgctggcctcgaactcgccgtaggccaggctgagttgatcgagcagctgcaggtcgaaggcattgcgcttggcgacccggtccaggccgatgaggaagagatgaccacgctgttcacggctgacgcgactgcaactgggctggctcatggggcatttcctcggacggtaaagagtgtctcggaccgacggtatcggccggcaagatgaaccgtttaagcgtcatcccccgacaggcgtgggcctgtgcaaaatagacctttgccggattatccgcaaagcctgtgacaactaggcattcagcgggtttttccgataaaaaaaactcccttttttgagtaattccggtatagtgcgcgccggcctttaaccgggcctcgtttaggtgatgcaattccccgaagtcagcttcggctgcttgtccgctgcgcggactatccttgacgttcatttctttcaatcgttttcgcaaatccccgccgacaaagctgccagggtgactcttgagtcttacacggcatgcgcagctttggagcatgggtctttgcggatgcacttagaggcagacccatgacccaggaaatcggcggcttcgccgctcttgaacttcatcccaatattgtcgctgcagtagtcgctaccggctatgaagagccttcggccattcagcagcagtcgatcccgatcatcctcgccggtcacgatatgattggtcaggcgcaaaccggtaccggtaagaccgccgcgttcgccctgcctatcctgcaccgcattgatccgtccaagcgcgagccgcaagctctgatcctggccccaacccgtgagttggcgctgcaagttgcaaccgctttcgaaacctacgccaagcaaatgccgggcgtaactgttgtggctgtctacggcggcgcgccgatgggcccacaactgaaagcaatccgtaatggcgcacagatcgttgtcgccactccgggccgtctgtgcgaccacctgcgtcgcgacgaaaaagtcctggctaccgtgaaccacctggttctcgacgaagccgacgaaatgctgaaactgggcttcatggatgacctggaagtcatcttcaaggccatgccggaaacccgtcagaccgtactgttctcggccaccctgccgcagtcgatccgcgcgatcgccgagcgtcacctgaaggacccgaaacacgtcaagatccagagcaagactcagaccgttactgcgatcgaacaggctcacctgttggttcacgctgaccagaagacttctgccgttctcagcctgctggaagtggaagatttcgacgccctgatcatgttcgtacgcaccaagcaagcgaccctggacctggccagtgccctggaagccaaaggctacaaggccgctgcgctgaacggcgacatcgcccagaaccagcgtgagcgtgtgatcgactccctcaaggatggccgcctggacatcgttgtggcgactgacgttgctgcccgtggcctggacgtaccgcgcatcacccacgtattcaacgtggacatgccgtacgatccggaatcctacgtgcaccgtatcggccgtaccggtcgtgccggtcgcgaaggtcgtgcgctgctgctggtgactccacgcgagcgccgcatgctgcaagtgatcgagcgtgtaaccggtcagaaggttgccgaggttcgcctgccggacgctcaagccgttctcgacgcgcgcatcaagaagctgaccaacagcctgtcgccactggtagctgatgctgaatcgacccacggtgatctgctcgatcgcctgaccgccgatatcggttgcagcccacgtgccctggccgcggccctgctgcgcaaggccaccaacggtcaggcgctgaacctggcagcgatcgagaaggaacgcccactggtgccgaacagcgcgccacgtggcgaccgtcctgagcgttccggcgatcgtcctgatcgcggtgagcgtgagcgtcgcgcgccgatgcctctggctgaaggtcgtgcccgttgccgtaccgcgctgggcgcgcgtgacggtatcgcggccaagaacctgctgggcgccatcctcaatgaaggcggcctggcccgcgaagccatcggtcgcatccaggtgcgtgacagcttcagcctggtcgagctgccggaggacggtctggagcgtctgctgaccaagctgaaggacactcgcgtggccggcaagcagttgaagctgcgtcgctatcgcgaagactgatcagtgctgagctgattggttgaacgaaaaaatccccgcctggtgcggggattttttttgcctgggggttggatcagttgtcgcatcgtgatgcgccaggcccggcagtggcatcaaccgaagcgatagatatccatgcccagcgcgcccatggtgaagccttgatgggcgatgctgaagtcgccaccggcgcctctggcgaagtacagcggcagcaggtgttcatcgctggggtggctgcgcacggcattcggtgcctggcgacggtagtcgtgcagcgcggcttcgtcgttggcggcgagcttctcgatcatccagtcgcggaacgccttggcccagggctcgatgctttccgggccagcgtgccaatccagttcgcgcaggttgtgggtaatgctgcccgagccgatcaatagcaccccttgttgccgcaggctggacagggcgtggccgacctgggtctgcaaggccgggcccattcggctgggcagggaaacctggaccaccggaatatccgcttgtgggtacatcagcgacagcggcacccagaccccatggtcgaacgggcgctggtcgtcgagctgcgctggcaggccgtcggccctgagcagctgcgccacctgttccgccagttcaggctggccgggggccgggtactgcacggcgaacagcgcggcgggaaagccgccgaagtcatgccaggtttgcggtcgcgggttgctgctgacccgcaggtcctggctttcccagtgggccgacaccaccactatggccttggggcgcggcagctcggcggccaggcgggcgagggccgggccgctggcgccgggttccagggcgagcatcggtgatccgtgggagatgaacaggctagggagcatgaataaggtcctgagcgttaagatgcaccatcttcaatcagatcattgatctaaatctaatataagtttttgtggtttttgatcgaatttcagggtgatttatgcagccggagttttggcacaaacggtgggaacagaatcagatcggcttccatttgtccgaggttaatccttacctgcaacgctactggccccagctggagctggcgtcgggttcgcgggtgctggtgccgctgtgcggcaagagcctggacctgagctggctggccagccagggtcatcaggtgctgggtatcgagttgtcggagaaggccatccaggactttttcagcgagcagcaggtgcagccgcaggttgagcttcgaggcggattcaaagtctatgagtacggcccgatccagctctggtgcggcgacttctttgccctgcaggccacggatgtcgccgactgccaggccttgtacgatcgcgcggcgttgatcgccttgccgccacagatgcgtgagcggtatgcggcgcatctgcagtccatcctgccccagggctgccaggggctgctgatcaccctggactacgaccaggcgctgatggcggggccgcctttcgccgtgctcgatgacgaggtcaaggccttgctcggtaagcgctggcagctgcgggtcgaggaggtgcgggacattcttggcgagagctggaagtttctccagggcggcgtgacccgcctcgaagaacgggtctatcgcttgctggcgcgctgagccccggcctttttccaggccatgaaaaagggcgacttgcgtcgcccttttttgtgtttgccagcgttatcagccgcgacgacggctcagggcgtcgatacgctcttccagcggagggtggctcatgaacatgcgagccaggccttgtttgaggccaccgttgatgccgaaggcattcagggtgtcgggcatgtgcaccggcaggccctgttccgagcgcaagcgttgcagggcgccgatcatggccgcggtaccggccagttgtgcgccggcttcgtcggcacggaattcgcgcttgcgcgagaaccacatgacgatggcgctggccaggatgcccaggaccagttcggcgaagatggtcgcgatgtaataggcgataccctggccttcttcgttcttgaagatcaccttgtcgacgaagttgccgatgatgcgcgcgaagaacatcacgaaggtgttcaccacaccctggatcagcgccagggtgaccatgtcgccgttggccacgtgaccgatctcgtgggccagcacggctttcacttcatcgggcgagaaacgctcgagcaggccctggctgaccgcaaccagcgcgtcgttcttgttccagccggtggcgaaggcgttggcctcgtaggccgggaaaataccgacttcgggcatcttgatcccggcttcgcgggacagttgctcgacggtttgcagcagccattgctcatgacgagtacgaggctgggtaatgatctgggtgctggtgctcattttcgccatccacttggagatgaacagcgagaacagggaaccggcgaaaccaaagaccgcacagaaaaccagcagctgattgaggttgagatcaaccccattggccgccatgaacccgttgaagccgaaaaggctcagggtgatgctggcaatcagcacgaccgccaggttagtggccaagaacagcaggatgcgcatcatggttgtagaaatctcctcatgctaaagatgtagcgttctgcggggtatataaggtgcggcaccggcctattcaaccgggtgactatttcaaactgtgtcctgcaggctgattttagacgcttgcatgagctttctgtcgcagttgggcagccaccggaagccgagccgcacttcagaggcatgcaaccactgggcacaaggcgcaaggcaaagatacagaagggtaggcgtagcagggagtacagaagtgttgctgaattaatcgcagtgcgaccggggcggccgcactgtgtcgcaaggcttactggcgatacgacttgaggaagctgccgatacggccgatcgcctgttccaggtcatcgacccgcggcagggtcacgacgcggaagtggtccggccatggccagttgaaggcggtgccctgaaccaccagcagtttctccgagagcagcaggtccaggacgaacttctcgtcattgtggatcgggcagactttcgggtcgattttcgggaaggcgtacagcgcgcccatgggcttgacgcaactgacgccggggatgtcgttgagcagttcccaggtgcggttgcgctgttccagcaaacggccgggtggcagcaccaggtcgttgatgctctgatagccgcccagcgccgtttgaatggcgtgctggctcggcacgttggcgcacaggcgcatgttggccagcatgtcgatgccttcgatgtagctctgggcgtggtgcttgggaccggaaatggccacccagccggaacggaaaccggccacccggtaggacttggacaggccgttgaaggtcaggcacagcaggtcaggcgccagggaggcggtgcagacgtgcacggcatcatcgtagaggatcttgtcgtagatctcgtcggagaacaccaccaggttgtgctggcgtgccagttcgagcatgtccagcaatacttccttggggtacaccgcgccggtcgggttgttcgggttgatgatcaccagggccttggtgttcggggtgatcttggccttgatgtcggcgatgtccggccaccagttggcctgctcgtcgcacaggtagtgcaccgggttgccgccggccaggctcacggccgcggtccacagcggatagtccggggccgggaccagcacttcgtcaccgttgttgagcagggcctgcatggccatgacgatcagttcggaaacgccgttgcccaggtagatgtcttcgatgccgacgccttccacctgcttttgctggtagtactgcatgacggccttgcgcgcgctgaacaggcccttggagtcgctgtagccctgtgcagtcggcaggttgcggatcacgtcctggaggatttcgtccggcgcttcgaaaccaaaaggcgccgggttgccgatgttcagcttgaggatgcgatggccttcctcttccaggcgtttggcgtgcttgagcactgggccgcgaatgtcataacagacgttggcgagcttgttcgatttgctgacctgcatggcgatgtgttcccgaaaatgaacgatccagacggtgagtgagctaccgtactgggaatcctgcgtttgcacacaggcctgaagcctgggttcgcggcggcaaaatccgtttgaacccgtgtaacacggctgccagactggcgtctaacgaggcgcaatcatacgtgccgcccgatccgtggaaaagatacagatcgggctttttcagttgcagaggaaggaccatggaaaagctggaaaaaacccttgaagaatggcgtgccatgctcgatccggagcagtacaacgtctgtcgcctcaaaggcaccgaacgaccgttctcgggcaagtacaacgccaccaagaccgacggtgtgtatcactgcatctgttgcaatgcgccgttgttcgactccagggccaaattcgattccggttgcggctggccgagcttctacgagccgatcggcgagagcgccatggtcgagatccgtgacctgagccacggcatgatccgtaccgaagtggtctgcgccaaatgcgatgcgcacctggggcatgtgttcccggacggtccgccgccgaccggcctgcgctactgcatcaactcggtgtgcctggacctggttccacgctgaccggagcgggcggccaaggcgatttttcggaatcgcttttcgatttattaaattgcacacaatttaattgagtactacttttatcggacctttcatttttcggagtccgcgccatgagtgacacattgctgaacattccgtgtaccaccatcaagggtgagcaaaagaccctggccgactttgccggcaaggccgtgctggtggtcaacactgcgagcaagtgcggtttcaccccgcagtacaagggcctggaagaactgtggcagacctacaaggaccggggcctggtggtgctgggctttccctgcaaccagttcggcaagcaggagccgggcaacgaaggggccatttccgagttctgcgagctgaactacggcgtcagctttccgctgttcaagaagatcgacgtcaatggcgccgaggcgcatccgctgttcgtgcagctgaaaaaacgcgcgccgggggtactgggttctcagggtatcaagtggaacttcaccaagttcctgatcggcaaggacggcgcgctggtcaagcgtttcgccccggccaccaagcctcaggacctgaccggcgagatcgaagccctgctcaaatgaccgacctgttcgccgattcgctgaaactcgacagccagctgtgcttcaagctgtacgccgcctcgcgggccgtggtgcggggctacaagccgatgctcgaccagttggggctgacctacccgcagtacctggtgatgctggtgctctgggaatggcaggccacgccccccgagctgccgacggtcaaggcactgggggaacgcctggcgctggattccgggaccctgacgccgttgctcaagcgccttgaacagctgcaactggtgcagcgccagcgttcgccccgggacgagcgcgaggtgcacctgagcctgaccgcggccggcctagcgctgcgcgatcaggtgccgccgctcaaggcggcgctgttatgcgacagcggggtcgacctcgacggcctgagcgaattgcgccatggcctggaccggctgctggcccaggtcaaagcgctgtcgtagtcggcacccagaggtccagcagggcaatcagctcttcacggcggaagggcttggacaggtagtcgctcatgcccgccgctcggcagcgctcgcgctcctcgggcatggcattggcggtcagggcgacgatcggcaggtccggccagcggccgctgcggcggatctgccggctggcctcgtagccatccatcaccggcatgttgcagtccatcagcaccaggtcgaaatgctggtgctccagcacgtccagggcctcggcaccctgggaggcgaccgtcacctcgcagccgagcttgctcaacatgcctttggccaccagttggttcaccgggttgtcctccaccagcaggatgaaggcgcggcgcaggggcgccagggtttccagctgggtttcattgatcaccgcggtttcggccagcagggcccggcgcagggtctgatacagggcgttgcgcgccaatggccgcgcctgttgctgcaacggcgccagggcgctggcttcttcgctgggcaggaaactgccgtaggcggtgaccagcagaatcggcgcgctgatgctcgggcgcaggccgaacaggcattccgggcagtcggtgatcagcaggtccggcttctgcccgagcagtgactcatcgagatcgcagcgccgatactccagcccccagaatggcaactgcacgctcaacaactcggccaggccgctgccttcggaggtaatggccagtatctggccgtgcagcggcggcggtgggctggctggcgtgtggcagggcagcggcaggtcggcacagaactggctgccgaaacccacttccgagctgatgctcaggcgcccctgcatggcttcgcagaggttgtaggtcagggccaggcccaggccggtgccgccgtattgccgggtgatcccggcaccggcctgggtatagggctggaagatcttcacctgggcctcgcgggcgatcccgataccggtgtcgcagacttcgatcctgaccccgtcctcgaacgtacgcaggcgcacatcgacacggccgaagcgggtgaacttgagggcattggacagcaggttgctgacgatctgtcgcacgcgcgtggggtcgccgaggaccagggccggaaactccggctcgatcaggcaggccagctcgacgctcggcgcggcgttctgcgacagcaggttggcggtgtcttccaccagtaccccgaggtcgaaggggatgcgttccagctccagctggccggcgtcgaacttggacatgtcgagaatatcgttgagcaactccaccagcactttgccggagtcgtgggcgatcgacagttgctggcgttgttcggcgttcagcgggctgtccagcgacagggcgatcatgcccagcaggccgttgagcggcgtgcggatttcatggctcatgttggccaggaaggcggcacgcgcctgggccatatcgagggcggtgctacgggcgacttccagttcttcgttggactggctcagccggtcgttgatcgccttgagctcggtggtgcgcgccgagacgatgttttccagctgcccgagatagtcggtcaggcggttttcggcattgcgccgttgctggatctcggtggccatgttgtcgaactgctggttggcgaccttgaccagcacgccgatctcgtcctgttcgtggctgggcgggaagtccagccggctctggtcggggctgcgcgggtcgcgcccgctgagttcgcgaatgacgccgaccaggggtttggtcagcatcacgtagaacagcgccagcagcagcccggtgaggatcaggctgcgcacgaaaccgttgatcagggtgatttccgcacgacgcaggaagcggctgccgaacgagtaggtgtcgacttccaggtgcaggacgccgagggattccgagggcaggtgatcgaggtacaggcggtcctggaactcgcgcttggcgccgaacaggaagtcgctgagcatccggtaggggctttgctgggccggtcgggtgacgttggccagcaaagtgtcgttgttgtcgatcagccgggcgcggatgatcgccggcgagcgcagcaggccgagggtcagctcctgggcgagctcggcgtcgatgttataggcgatacgcgaggccggattgtggctgatttccagaagggcgttgatttcccggttgatggaggcatcttcactggcataatcgatgccgatctgcagcagactgagcgccgtccccaggacaaacccgaccagcacagtgagcctggcttgcttgtaagacaggcggttggtgaacttgatgtccatggggtgttgaaccaatttccgtttcccttcgctgggcaagcatagctgatcgtcagtgtgtgccggcagggcccggcgccgttcgcctgcggtagaccaggcatgcgcaaggtcgttgcgtctgcgtgccacatcattactgggaacctgcccgaggagaagtcgtggaatctcgattgaatgcttttcttgagcgcgccgatgcggttctggcgcgtatcgagccgctgttgcccgcgccgcgacaagccatcgactggacccaatgcctggccgcgcgctggcagcgtgaaggccgcagcggtttcctgctgccgctggaggtcagcctggacatgcgcctgtccgacctgatcggggtcgataaccagcgcgaccagttggggcgtaatacccggcagttcctcgacggcctgccggccaaccacgccttgctgtggggctcgcgcggcaccggtaaatcgtcgctggtccgcgcgctgctggccgagcatgcccagcatggcctgcgtctgatcgagatcgagcgcgatcacctggccgacctgccgcgggtggtggagcaactggtcaagctgccgcagcgtttcgtgctgttctgcgacgacctgtcgttcgattcgggcgaaggcgactaccgggtactcaagagcgtgctcgacggctcgctggagcaggccccggacaatgtgctgctgtacgccacgtccaaccgtcggcacctggttccggagaaggaaagcgacaacgagaactggaagcgcgtcgatggcgagctgcacccgagcgaagcggtggaagacaagattgccttgtcggaccgttttggcctgtggttgtcgttctaccccttcacccaggagcactacctgaatgtggtcgagcactggatcggcgagttgggacgcaaggccggtctgcaatggcagcgtgacgacgccctggacatcctcgccgtgcgctgggccaccggccgtggcaatcgcaatggtcgctgcgcgtatcagttcgcgcgctactgggtaggtttgaagttgttggagcaaaaagcatgatcgatctgcagaacaccggcaaaggcctggacggctatgccttgctgtgcgcccagctggaatcgttgctggccgacgagcgcgatttcatcgccaacgccgcgcaattttcggcgtttctgttcaaccagctggacgacttgaactgggccgggttctacctcaatcgcaacgaggaactggtgctcggcccgttccagggccagatcgcctgtgtgcgcattcccttcggtcgtggtgtgtgcggcgcggccgcggcgagcctgcagacccagcgggtcgaggatgtgcacgcgttccccgggcatatcgcctgcgacagcgcttccaacagtgaactggtggtgcccctggtcaaggatggacggctgatcggcgtgctggacctggacagcccccaattcgcccgcttcaccctcgaggatcaggccggcatcgagcgcctggcggcaatcttcctgcgcctgaccgactgctgagcctcgtcagtccctgagcccggccttgcccagcacggcctcggggtctaccccgtcgatctgctgcggttccatgaagcggtcggcgtactgctggtagatcccggtctggatgaacagctcgaacagttccggatcgatatgggcagtgcggcacatggttgccatgatgcccagcgcttcgctcagggtcttgcccttcttgtaggggcggtccgccgccgtcagggcttcgaagatatcggcgatcgccatcatccgcgccggcaggctcatctgctcccgtttcagctgcttgggataaccgctgccatccattttctcgtgatggccgccggcgatctcgggaatgctgctcaagtggctggggaagggcaggtggttgagcatcaggatggtctgcaccatatggtgattgatcacgtagcgctcttcccgggtcagggtgcctttgccgattttcaggttgtacagctcgccacggttgtacttgtagggcggcacatcgagcttgaagccccaggggttgtccgccgggatcagctcggcggggttgcgttcgatcagatgctcgggcttgtcggccagcagctgttcggtgaccggcagggtcggtgccggtgtgcgttgctggcggtggttttcttcccatgacacgcccaggcggtcgtccagggtgcggctccaggtgcgccgggcaatgctttccagtcgttgcagatcggcctcggccatggcttcgttaccgaggttgcagcgggcgataaaggcaaagtcgtcgtccagttctgccaggccggcatcgcggatcgccgccagggaaacctcatcgccaccctgggcgcgggcctgccaatagtcgatccagagatcgcgcttgagcacctcgacgcgggtgcggatttcatggatgcggtcgttcagggtttccagcttggtggccttgtcgaccacgtactcgggggtggtgatcttgccgcaatcgtgcaaccaggcggcgatatgcaaggcctcccactcatcttcgctgggctggtaggcgctgaacgccggctgctggctggccgcggcggcctgggccagcatcagcgtcagcgccggcactcgctggcaatgcccgccggtgtacgggctcttggcgtcgatcgcgccggccagcagctggatgaaggcgtcgagcaattgtttttgccggttctgcaggcgctggctgtcgatgctgaccgccgcggcgccggaaaccgcctgcaggaacgcgacgcggtccgggccgagtttttccaggtcggcttcctggccgctgtcagccagcagcagcacaaggatgccgacggtttcgttgtggcgattgtgcaggcggataccgatcaggtgcacgctggggcagttcatcgccagcagcacgccttgcaggtcggccgcctgctcgaaccccagggtcgtgaccaggctctcgccgttcgccagttgccgcagccatgcggggcttgcctcgtgctggatgtcctggctgcgtacatcgaacgcctgcaagtcctggacaacaccggcgatgatcaggccgtggggcttgaggttcatgccatcgttttcgcgcaggtagatcagcccggcctgggcctggccgatcttcatggtttcaaccagcacccgttgcagcagcgggtcgaagcgggtttccgcggaaaggctggcagtgatctcgaaaaagctggccagggtgtccttcatgcgggccatcgacacgctcaactggtcgatttccagcacgggcgagcggcgcgtcagcgggtaatcgaaatcgaaactgcggatggcatcggcttcctgcaccagggcgcgcagcggcctgaccagcacgcgcgaggtcaaccagccgagcggcaggcacagcagcagaatgcccaaggtgatgagcgcgccttgccagcgcatgcgataggcgtccgccagcagctcgtcctcgggcaccagcagcgccagctgtaacccaccgggtccaccttcctgcaggtgccggctggcaactatccattggcgatccttgagttgcaggcgattgccctgggccttgccttgcagcaacgcgtcgagggccgggttcaggtcgttggcgcggattagccgggcgctctgttcttcgacgatcaggcgacggctgtccgggtaggccacggcatggccattgccatccaccagggcgatttcggtgctgggcgtgacccgatgcttggccagggtcgccgagagttgttccagggtcaggtcggccccgatcaccgcatggttaccgctgcggcgggcgagggtggtgccgacgttgcgggtcgagaaaaagacgtagggctcggtggtgatctgatcggtgtcgtccttagcgcccgcaaaccagttgcgggcgctcgggtcgtaggattcctggggattgtcgcggcggctgacggggccgaggctggcgtcgtagaacagcgactgcgaatgcagttgcccggtgtggcggtcacgctcgatgctccagacttcgtaggccgcggcttcaggggcctggcgagcttgtttcaaagcctgggtgcgcaagggccggaccatgaaaaaatccccatcggcataacccacatagagtgaggccaggtcggggttgtccttgagcgattggctgaaaggcccaagcagcgccaggcgttgctcgaggtcgccggcctggatggccgggttgcccaccagcaggctgagcagatggcgaatcggttcgtaggtcgctttcaggtccagttgcacgtcctgttcgatgcgctggaacagtttttcactgctggaaaggatgatgcgggtggtctgctggtaattgaaaacgcccagcaccacgccggtcagcagaagcaggcaggtgaacatcacgctgatatgcacatggagaggaaatcggcgtttatcgaacgacagcgtgcttggcattgcagctctctccagggggcgcgtgatgcgcaactcaacgtttgagcatagttaaggcaggtgcattgcgctcaggggaagcagctccgggagggcgttgcgaattgcattgccatgaggcgtttggggccgactgacaggatagtggctttttgatatttgtctggcaactagccgccccacaagttgctgcgctggtgatggggatcaggtcgtggccgggctgtgctgttgatcgatttgccacagcagggcccgttcgagcttgagcatggcctgttccagggcggttctgcgctgcagcaaggtttgtctgtccgcgtcttgcaaaacagcctgctcaagggcttcgcactgcgcttcaaggtcttttgcctgcaccatcagggccgagcccttgatcttgtgggcgagttccgccagtgcctggagcgggggctcgcagggcagggccatcagttgctggcggtcccggtagctgcaatgcagtagttcggtaaggatgcgcagggcgaactgcggtttgccgcgggacagggtgcgcagcgccttcaggctgaacacgccattccagggccgcggttgcaggcccgccagtttatggctgagggtcgccaggccgacaggtttgaacaggcagtcgtcgatgccggcctgttcgcactgctgcctttcgcgcggcctggggctggcggtcacccccaatacccggcaagccgcacgggactccaggcgttcatgctcgcggatggcgcggaccaggtcgtagccgtgcatgcccggcatgttgcaatcgacgatgagcaagtcgaagaaccccttgcaccagagctcgaagccttgctcgacgtcttcggcggtgcggcaacggtgcccgagaaagtgcagttgttcgctcagcagcaggcggtccgccgcatggtcatcgatcaccagtacgttcaaggcccgggtggcaggggcaatgagtggctcgacgaggggcgcgggttttcgcgctggctgacaggccagcggcaacaggacccgggcttccgtgcctatgcccggctggctggtcagttgcagcgtgccctgcatgagctcgcagaggtggcggcaaatggtcaggcccagccctgcgccgtcaggtctggatggggtgcgcgcctgggcctggaagaagggttcgaacagcctgtgctgatcctgctcgtcgatgccgatgccgctgtccgtcacttgcagcatcagccgcacctgttgcggctgcgtggccgcttgcaggtcgagatggattttgacctgaccctgttcggtgaacttgatcgcgttgtgcagcaggttgcccagaacctgcttgaaacgcagtgggtcgagcagcacatcgaccggctcgacgctggagtggaaggtcggtagcagcttgaggtgtttcttccgggcctggctgtcgaactccctgacgatggattcgacaagggcgcgcggctcgagccattcgggcgccaggtccaggcaccccgattcgatgcgggcgatatcgagggtgtcgtcgaccaggtcctgcatcgcccgggccgaacgataagccatttcaatgaccgggcgatcctgggactggttgtcggagcgctgccgcagcagttccagcgcaccgatcagggcattcatggagcggcgcagttcgtggcaggtactggccaggaaagcgcttttcgccaggctggccgcttcggcctgttgtagggcggccttgaggctgtcgctgagccgatggcgttcgctgatatcgacccaaccgccgatgatgccctggacctcgccgttcgcgtcccggtagggcaggacccagtgttggacggtcagctcctctccgttcaggcgcagtggccggtcaagcagcagcgggctgtcttgcgccatgacgcgctggtagtcggcgtgataggcgcgggcctgctcgggatcgtccaaaagtccatgcaacaggcttttgccgatgacctcttcgcgccgggcggcgaagctttccaggtagctggcattgcagctttgcagcaggccctggcggtcgcgcacgtaagtcggatgaggcacgccgtcgatccagacctgcatgaatgcaagctgatgcctgaagtcatgggtggcctgttgctgctgggtcagtcgccggtgcagccaggcattccaacccagggacgccagcagcggcacgccgagccccaggcctgcgagcaggagcagcccgcgatggccgttatcgagaggcggggcggcggccgattcaagacaaggcgcggtgtcagggcactgagggagggatgtctttgccaactctggttgcccggcctcgaccaggccaaacaacagaaacagcgaaactgccgtggccgtcagggttaaataataaagaatgggtttgaacatcctgtttctcacaccagttcgtgacgttgtgccaactcgataagttccgccatggaagtcgcgcgaagtttgtgcatgattctttttttataggtactgacggtcttgccactgagaaatatgctgttggctatttgcgtactggtgctgcccttggcaaaaagttgcaacaccatcaattcccgatcgctgagcaacatcaagcggctcagttcgttgtttgtcgtttcatcctgacgcggcgtttgcagggcatggctcggaaagtagttgtagccgcacaacaccgccttcatggcgctgagcacttcgctcaggtcttcctgcttgcacacatagccgcaggccccggcctgcatgcagcgcgcggcgaacagggccggcgattgtgccgtcagcaccagcacccgcaaggacttgtccagggcgccgaaacgcagcagcagttccagcccgtcgagcttggggatgctgatatcgagcacgatcaggtccggcatgctgtcgcgaaccatttgcagggcatcgacaccgttatcggtttcgccgacgactttataaccctcatgttccagcaacatgcggatggccagtcggataacgggatggtcgtcgatgatgaaaacagaactcatggtcaaacccgtggaaataaatacaggtctggaccttagcgcaggcaggacagtggatatatgcgggttaaggcggggttggggacaataaggcagttcttacatgaaagacggtttcggattacagcggtttttcagttgaaagtaggaatgagtatccagccatgtaaaaggtaaggagatattggcggtttagtgcactttttcgcagggcaataaagggcgctgagaagagaagggagccgggcaaggctgccccccgttcatgggggggggcagccgcttacggagcgcttgcctcagggcgctttctgatcgatgccggcctgcagccgctggctgtcgttatggccgccgacacgcagcggccccaggttgaacgcctggtcgttgcgggtggcgtcgtcctgcttgcgggtcagctcatccttggcgccgagggccaggttgaccggcgacttcgacaggttgagcccgacgtcggcgcggtaatccgtgcccgccagcgcggtgctcttgacggtcgagccgccgaggtcgaccttgccttcgctggcgccgatccgcgcgccgctcagctgggtttcacccgacacctgcaggttgaccccgtggctgccgctgatgccagaagcctctgccacgctgtctttgctctgacggctgacattcaggttcagggtcggtgtgtaggaggtgttgccgctcttgtcgccgaacagcacgccttgcgcggtgttggtcagcttgctgccagcgccggttttctcgctgacggcgtagctgtcgctggttttcggccagacccgttccttgaggctggagaagcgctcgcccaaggcttcggttttgtcggcgaggtagctcttggctttgtccacgccgcgaccgaaggcgcccttgggttccgggttgacgtcatagctgccgctgcgggtgaatttctcgcccaggcgttccttggcgatttcggccttgttcaccaggttgtccttggccgcagtcaggcgctcggtgcctttgtcgacgacgttttccagcttctcgcggtgcttgtcgaaaccgccttcggccttggcctgcagcttgtccttgagcgggccggtctgtttggtcagcttgtcgaccacgccaggctggttcttctccgcgtccaggcgggcgtcgaggttgaccgtggtgctgctgagctggtccttgcggctctctaccttgagatcgccaccgatccgcccatcgacctgattggcgtcgatgcgcgcccctgccagatgggtgtcgccgttgctattgagcgtcacctggtcggccttgatcaggctgttgtgctgggtggtgctgtgcagttgctcgacgtcgatcttggcccgggcatggataccgcgatcggttttcggcgagtcgtgttcgccagcgtcggcgcgggtggtcttgccgccattgccgccggcgcccagggtcaggccccagttgttgtgggcctgggtggattgcgccgactcctggtagatcccgccctggtcggcgctgagggtgacacccttggcctcgatctgggtgccctgcaggtgcagcgcggtagtgctgtcggagccgctggcgagtgttacctggccattgctgtgcagttgcccgccggtctggttctggtcctgttccgagacccggccgatgttgaagttggcgctcaggttggcgctcttgccgctgctctgctcgctgctggtcttgctggcgccgcccgtcaggccgccaccgaggttgctgccctggctgctgtgggtgtcgaccgcggcctgcaggtcgagtttgccgccggcgttcaggttgatgtcgccggtcttggcggtcttgctgccgatggtggtgccctggaggatcaggtcgccgccgctggtcaactcgaccgggcccttgccctggatagtcgcgacccgcgcctggctgtcctgctgatccaggcgcttgtggtccagttgcaccccggcgccgaggttgaggttattgccgttggcgcccggtgcgctgccgacggtgagcgaggcatcgccgcgcaggctggagtcgctgctgctctgccggtcattggcctggttcagcgccagttcgccgccgctgtgcagcttgacgccggcgtcgccgccatcgaaccggctgccttcgtactggccatcgccgttcagcgcgatatccacgccctgtttgccgacatagctgccgaccaccgccttgctgctgtcgctgcgcttgtcgctgctgccgccggcgccgctgccacgcacgttcacgtcctcgccggtggtggtgtagacccgcacgccggccttggcgtccagcgcctgctcgctgctgctgtgggtatcgctggcggccttggccacctggctgccggcgtcgatcttcagcgcgccttgagtcgcctcgtagcggctgccttcatcctgcagctggccggcgaccttgacctcgacctggccacccgtgaactggctgaccaccgcggtgctgccttgctcggtgcgctgtttgttctggtggccgacttccacatccaggccaacattgggttgttccagggcatcgagcaggcccggttgatggaacttgcgctgggccacgccttcgatggctttttccaccgggcgggtcaggcccttgtattcgacgttggcgccgatatcggcgctccaggtgttttccttgtggctggtggactcgctgtcgcgcgccgcgcggttgtcgacctgctcggccttcaccagcagcttgtcgccggccttgacctgggcaccctcggtcaccagggtgttgccggccttgatggtcaggttgccgctggcggcgatgccggtggtgttggcggtgctgctgtcatgggtgtcctgggtgctgctgtgggcgaactccacaccgttgcccgcgcggtccaggccgccggtgtagtagaaaccgccgccggtggtgcgggtgtcggtgctttcggtcttgctgtcgtgatcggccagcaactcgacctgctggccgctgaggctggcatcgccttgggtggctttcaggtcgccgcccttgatgctcaggttgcccttggcagcgacttccaggctgccgccgctgaggctcgaaccctgttgttgggtgtcgctggtcttgaccgttttctgctggtcttcgtaacgcacgccggcacggtattgccgggtgcccggggcattttccttggcgtaggcgtcgaagccacgggtgtgggtcgttttttcgctctgcgtagtgtcctgcgccgagtcgatcttgatgtcgccgtcggccttggcttcgagcttgccggtcgcggtcacttgcgcgccgctgatggcgatgtcctgggtgcttttaagctcgaggttgctgtccgagcgcaggtcgctggtgacggtggtgctgtcgttgcggttctgccggctttcgtccttggtgatgccgaagaacttgctgtccttgctgtagctgttgtcgtgggagcggtcctgcacgccgtcgatggtcagcgagccgttttcgctgatcacgctggcctgcttgccgccacgggcctggctgccgctgatgcggacttcgtcggccttgacgatcaggtcgcccttggcgttgaccttgctgcccttgttcagggtcttgcccttgtcgccgtcgccgttcttgccgaagaaactaccgccgaccaggtcgccggagtaggacttgtcgttgttgctctgggtgcggctggcgctggtgatgtccacctggcgcccggtcagctggatattgttgctggccagttcggcgccctgcagttgcagctgcttgcgactggtcagttgtaactgttctttggcctccaactggctggtgatactgcgctgttcgctgctggacttgtcccagtcggctttccacaggtgcttgcggtgccggccctggtcgcgttgttcgtgggtttcggtggcggcggtcaggcgcaggtcagcaccgctgtcgactgtcaggttgtttttggccttgatctggctggcctggatttcggtgttggcgcgggccttgagctcggcatcgcggcgggcggtcagttggttgccgtgttgacggctgtcgctgtcggtcagggtgcggtcgtaggtttcccaggtgatgccgatggtgctgttgtgccactgctcgcgcttttcctggagcttgcggctttcgatggcgctcagggtgaggttgcgcccggcgtcgagcttgatgtcgcgagcgctgacatcggtggcggcgaggctcaggtcctggccgctacgcaactgcacgtcgccctggctgctgtgcacgccggcacgggtggcgtcgaggctgtcgggcctggcctggccgctgatgtgcagatcgccggcggacgcgatattcaccccgttgtcgcccttgacctgcaccgcgccgacccgcacgcccgcgccttcggcggtgctgacaatgttgatgcgtccggcttgcatggcgccgaacaggctggcgtcgatgcgctgctcctgggtgttgccgaccggatcggtgctcagcaccttgccgctggccgggtccacgcggttgcgcccgacggtgaggttgagctggtcgccggcagtaaggtcgccctggctgtcgatgcgcggggcgatcaggttgatgctgcccttgacgttgctcaggcctcggccctcgaccgtcaactggcccttggcgtcgcgggtgctcagggcttgcagcttgccgtcgttgagctcggggcggccgaccagcaggctggcgttgggcgtattgatgaagctgccgccgttgaccgagatgccgttggggttggccagcacatagtcggcggcgcggccgaagatctcctgggcgccgttgagcgccgaggcgttgcggctgatcacctcgttgagaatcacgctggcgtcctggccgtggaactgcgggttggcagccagctgcccggccagttgcgaggcgccggcttgcagggcgttgttcagcaccacgccctggcgatcgacgttgtagtcgaggaactggttatgggagagcccggcgccattgggcgcgacgatgttgacgataggcacgccgttctggttctgcagctgcgggatgccgcccgggcccggggccacggtgatgccgccggccagcgcctgcggcagatgggagaccagaagcaggctggcgatggccaggcgcagtttgcccctgggggacaggtgaaacacagatgtgttgtcgggcataagaagctctctatgtgtgggccgagtggcagtgcgcgttgttcgttgcaacgctgctgtggtgttcaggctcggctgtttttttcaggctgatgcacggttcgcgggacctcagatctgcacactcaggcgggtcagccaggtgggcgattcatggtgaaaacgctcgggtgtttccaggctgtgctggtagtcgacatcgacttgcaggttcttccagctcaggttcaggccgatgctggcgctgctcaggcgctcgctgctggcgccttcttgcgccttgatccggccgtgatcgaaggccaggcgcggggtcagcttgaccggcagatcgttctgcaacggcaagcgcagggtgttgcgccagatcccgccgacggcgcccgaggcgctgttttcgcgatagccgcgcacggcggagtcgtcggtgcccagcagttgttcgatggccggcagcgggtcggggctgtactgcagcgacagctggctctgccactgccagggctggctgccgaagcggccattgcgccattggctgaggctggcgcggtacttgcggaactgcgcctgcggcaggtttttctgcacctgttgcgagtcgcggtcggcgccgaaccaggtcaggccctgggcgtaattgacgtcgaggttccacaccgcgctgtcgagccagaacaggttgagcccggcttcggccacggtcagggtcgggctctggatgcccaggcggactttctccaggtagctgtcgacatccttgtgggccagttgcaggttggcgctcaactggtggccctggtcgcgccacagcacgcggtcggcgcgcaggctgagcaggtcggtgcgcccgctgttgtagaaggtcacgctgctgagcttgaacggcgcccggtactcggcatggctggcgaacaggctgtaggtccagtagccgtaggggatcgaatagaaaacgctggcgctgcggctgtagcgcggaccgtgattgagggtgtcgctgaagttcaggttgagcgcgtcgttgagttgcagcgggctgtcgaggctcaggttgacggagttgcgatcgcgcccggtactggcgctgccgaggttatccacacccagccccagggcccagcgcgaagcgccgctgctgcgcgagcgcaggatgatccgcgaggcgccgggctggctgccgggggcgatatcggcggtcaggtccagggagcgcaggcgattgagctggtccaggccctgttccaggtcgcgcaggttcagcggttcgccgagcatgccgggaaaggccccggccagggaaaccggcaggctctggtcggccagctcgacggcctcgacatacccttcgtcgaccacgatatccagcgaatggccggcggcgggggcgctgctcagataagggcggctggcgatgtaaccggcctcgacatagatccgggtgatctgcgccaataggcggttgatcccgttcacgcccatgcagggcgcgatatagggttcgagctggcggttcaattggtctttcttgaacagcgtgacaccggcgatccgcgtgccgctcagggcccagcactgttcatcctcgccaccgtgggcggtttcggcgggagtcaccgccggcgtaccgaagctgccgcgctgcaactggcgctggcgctgttccagctgcagttgttgcaggtcgcgctgttgctgttgctgcaggcgcagggcttcctgacccggttgtggcatatcggcggcggccacgggcagggccccggccagcagcgagagcagcaaccagccgcgcaggccagggtgacagctggggtgacttgaggacgtatagggcactcgacatccttaatagtggaaaacggatgaggaagtgcgggaacaacttatcgacacggattcattccgtgtactcacttccattttgacgcttgagtcctgagcgcgctctttgttacagcggggggtgaaattattttgcaaatgcctgctgaactaacaggtgaagccgaagttgtagtgtgggtacttagttcgcttgctatttgtttttttgcaccgatcattcgggcagggtcatgaaaggggaacgatctgtcgcggagtgaaattaatcctggttaacccattagggttcgagactagcggaaacgataaagttgatttgtacggaatttgtaatcgtggggcatccgtaggggccttgtgctgcaagggtttctgcctgaaggctaggcagatgtatcgaaaggtaaaggtaggatgtttggttgtgtcgttaacgatctgtttaattcggtctagttggcttgcttatcgggctgtatgtatcggtcaatatcgctagttatagagcaagtgctctaggtggggcgggtgcgtggaatattgtcgatctggatggcgtctggcgaacttgctggaagtgaatggcactctcaatacagtgtgaagtggccgggatttcaaagttgaagtaacggcgatggccggttactgcctgagaagagactgggggaattccttagttgtcgactcacgagaaaccgctcgaacggccacctcgataacgcgaggtagccgttcgacggagagtcattgcgggctggaacgcccggtcatttcccgggccatttcgctggcgtagctgtcggtcatgccggcgatgaagtcgatcatgcgcaggaatgaggcatgcagcgagccgttcggatccggtgcgttgttgcccagcaggtcgagaatccgccggttcttgaacgacggcgtgcgtccgccgtgctgttccagcgcggcgccgcagaacgaattgaggaggatttccagggtggtgtaggcaccgatctcgtgcagggtcttgcgcttgtcctggaagatcttcttgcgcgcgatgtccttggcattgagcacgcaacgcttggccgggccgtgcatgtgctccaccagatcacccggcagggtgccgctgagcagggcgtcctgctgttcgacgaaggcccgggcggcggcgttggtcaggtgctcgatggctttgccgcgcaggatcgccagcttgcgccggcgcgagtcccgcgggccgagctggcgataggtttccggcaggtcgtcgcccaccagcccgagcagcagcgactcgacttcggcatagtcgagcagctccatctccagcccgtcctcgaggtcgatcagggcatagcagatgtcatcggcggcttccatcaggtacaccagcggatggcgggcccagcgttgctcctcgagttgcggcaggccgagcttggtggcgatctgttcgagcaacggcaactcgctctggtagcagccgaacttgtgcttcttgtagcccagggagtcggcgtggcgcgcggtccaggggtacttcaggtaggtgccgagggtggcgtaggtcagccgcgtgccgccgtcgaactggtggtattccagttgggtcagcacccggaacccctgggcattgccttcgaaattgaggaagtcgttgcgctcgttttcgctcatggcgtccagccagccgcgcccggcggcctgctggaaccagtggcggatcgcgtcttcgccggagtggccgaacggcgggttgccgatgtcgtgggccaggcaggccgattgcaccaccatccccaggtcgctgggttcgcaccactcgggcagggcgtcgcgaatggtctcgccgacccgcatgcccagggagcgaccgacacagctgacttccagggaatgggtcaggcgcgtgtggatgtggtcgttgctggacaccgggtgcacctgggtcttacggcccaggcggcggaaggcaccggagaagatgatgcggtcgtggtccttgtggaaggggctgcggcccagttcttcagggctgtgcagcggctttccgaggcgttcgcgggtaagcagggtatgccaatccaaggcggggtctctccgtcgaatgactgatgggctagcttcccggttcgcgccagcgcctgcaaggggaacaggttgaataacggggccgaccacgcacgccactaaagccccgcggcatcgatatcgatcaacagcaggcgctggccattgtcgaagaactgcccggcggtcaggcagtactggttgctggtggcgtcgcggtaggtgttcgacagggtcagccgccgctcgtcccagccttcggccagcaggtgatagaagtacgggcgccacgaccagttgtggccgacgtagctgtggtcggcctgccaacggtcgtggcgccattccaggtttggcgtcagctgggtgccgtggcgatcgcattgatagaagcgcagcaaccagggaaaggcatccagctggggcaaccgttcgatcggggcccgggcctgggcccagtcctgcagcagggccatcagctccgcgagttgttggcgcatctgcatcaggcgtccgcgctcggccagtttctgttgcacatagcgctggcgtacccgggcaaaaggcgcgacgaaagcatcgctggcgaagaacgcctgctcggcccgggcaaacaggaagccctggacatagcgcgagccgcattccagggcgaagttgagttcggtttcgctctcgaccccctcggcgataatccagcagccggttttctcggccatctgcgccagggccttgaccacgtcgctgctgggcccgccacgggccgcggcctggaacaggcgcatgtcgagcttgagaatgtccggttgcagggccagcacccggtcgagctgggagtaaccggcgccgaagtcgtcgatggcgatccgcacaccggcttcgcggtagcgcgccaccacttcgctcaggcgctggctgttgccgctcagttcggtgatttcgaagaccacgcgccgcggatcgacgccctgttgctgcaattgcctgaggctcggcaagggctggccggcgcgcaggcggctgatccagcggggcgagatgttgatgctcaggaaccagtcggcgggcgcttcatgcaggcggctcagggcgtcggcgcgaatcagccggtcgagccgccgcagggcgctcgaggaggtccggggatcgttgaacaatgggccgaccgacagcagttggccgttcggttggcgcaggcggcccagggcttcgacaccggcaatacggccggtggcggtgtcgatgaagggttgaaagcaggcaagcggttgcccgtcgatcacggggcctccttggttgatcttgttgatcctggcgctgcgccgacgcaacaggcaggcacgacccgacctctcgtgggagaggccgggtgcgcagctattgcgggaatgattgcaagaatgcagccagatggcggctcagtgcttgttcgaagaaccttgcatgaccagcttgatcagcggcaacaggccggcgctgagccgcaccagccgggcgaagcttctgacgctgccgctcttggcgcctttgccggtgagaaaccccaacagggtcacggcagccacgccccacaacggcgcgtgcttgatgcccaagccctgttgccagctctggccaaggccccggacccgctgcaagggttgcagcaactgttgggattcgtggcggatttcctggcggtgcatttccatgcgcaggcggatcagcgccttgcgcatctcgcgccgggagttggtttgcgggatgtcaggcaggctcatggcagcaggcgctccctgtcgttggccagctcttcaagggtggcgtggaagggcgaggactcgtcgaaaatcgccgccttcaggcgcagggcgcagaacagcgccgccagcgtatagaagacgcacagcccgatgatggcggtcaggcgataggtgtcccagaacaggatcagcaccagcgccgacaggcctatcaacagcaacagggcgaataccagggccagcccggcgaacagcagcaggctgacggttctggctttctgttcctgcaactcgatgccgaacagttcgacgtggctgtgcaacaaccccaggaaagcagcgcccaggcgccgcgttgaagagccttggcccgccgtggagccggattcaccgatagccatatcagcgccgggtcgccagcaggccgatcagaaagcccacgcccgccgcgatgcccactgcttgccaggggttgctctgcacatagtcttcggtggcggtgactgccgcctggccgcgttcgcgcagcgattgttcggtcagttgcagggtctcgcgggcgcgcagcaggctgtcgtgaatctgcgtgcgtaattggtctgcctggtcgccagccagggtggcggtgtgttccagcagacgttccgtgtcactgaccagtgcctgaaagtccgccatcagtgtttcttgagctgtcttggtggttttgctggccatggttatctccgtagtggcgttctgaagggttcgagtatgagccttgcgcgaaggttcagtgcaattgtctggtacagcttttgctttgtcctggtgcgtaaacacgggtggttgcgccgaaagcgcgcagaatgcggtgcctggcagctaaaaccttaccctaaaaaatcaacacttatggaaacaccccgagcgatacatccctctcgcaaaagcgtcgcgccaaaatgggtcgcaatacctgggtcgacaggaccttcggtgccaagttggtgcaaaaaacgttcgagcggctcgcggctttttcctgaatatcaggtctgcccattccatggaaaatctgcaaagcgctgtggacactctggtccatggttccaataccctgttcatcctcatcggtgcggtcatggtcctggccatgcatgccggcttcgcctttcttgaggtgggcacggtgcgccagaaaaaccaggtcaatgccttgtcgaagatcctcagcgactttgcggtctcgaccctggcctatttctttataggctattggatctcctatggcgtcagcttcctgcaaccggcggcggtgatcagcgccgatcacggctacgggctggtgaagttcttcttcctgctgacgttcgccgcggccatcccggcgattatttccggtggcatcgccgagcgtgcgcggttcgtcccgcagctctgcgccacggcgctgatcgtggcctttatctatcccttcttcgaaggcctggtgtggaacggcaactatggcctgcaagcctggctgctggcgagcttcggcgcgggtttccatgatttcgccggctcggtggtggtgcatgccatgggcggctggctggcgctggccgcggtgctgttgctcgggccgcgcaacggccgctaccgcgacggcaagctggtggcgttcgcaccgtcgagcatcccgttcctggccttggggtcgtggatcctgattgtcggctggttcggcttcaacgtgatgagcgcgcagaccctgcaggcggtcagcgggctggtggcggtgaattcgctgatggccatggtgggcggcacggtagcggcgctgatcgtcgggcgcaacgacccgggcttcctgcacaacggcccgctggccgggctggtggcgatctgcgccggctccgacctgatgcatccggtgggcgcgctgatcaccggggcgattgccggcgcgctgttcgtctggtgctttatcgccacccagacccgttggaagatcgacgatgtgctgggtgtgtggccactgcacgggctgtgcggcgtgtggggcggtatcgcctgcgggatcttcggccagagcgccttgggtggcctgggcggtgtcagccaggtcagccagttgatcggtaccggcctgggcgtgctggtggcgctggtcggcggctttatggtgtacggcgcgatcaaggcgttctgcggcctgcgcctgacgcaggagcaggagtattacggcgccgacctgtcgctgcacaagatcggcgcggtcagccaggactgagcccatgcggccctggctggagtctccggccagggtcgcttgccgctgatcattggccgccgagcaggcgcgcctccgacgcttcgatggccgccagcgggccggacatcaacaccgtatcgccggctcgcagcagggtgccggcggccagctccaggtcacggccatcgcgctgcaccccttgcacatccacgcccaattgctccagcgccagctcgccgagggccaggtcgcaggcgtgggccgcgctgccaagattgaccgcatgcatcagcacccgcggctggccgcgattgtccagcaggtcggtctgcgcgccatggtagaagccatgcagcaggcgatagcggttgtggcggacctcatcgaccttgatctgtacctggtgttccggcagcccgagcatcaccagcgcatgggacgccagcatcaggctcgactccagcagctccggcaccacttcgctggcgccggcggctttcagttcggccagttggctgtcgtcccgggtgcgcaccaggatcggcacgtcgctgttgatccggcgcgcgcttttcagcacgttgagggcgatgtcggtcttgtccacggcaatcaccagcagtcgcgcgcgttcgaggccgaccgccgccagcagctcggcacggcgggagtcgccgtaatgcacgcagctttcgccggccgcggcttcctggactcgtaccgggtcgtcgtccagggcaatgaaatgctgctgttcgcggcgcaggaaacggccgatcgactggccgacgcggccatatccacagatcaccacatggtcctgcaatgcggcgttgagggcgctgatttcttccaggtgggcctcctggttcggcttacggtgcaggcgcgcggcaatgcccggggcggcgcgcagcagcaggggcgtcagcagcatcgaacagaaggtcgcggccagcagcaggccgctcagctcggccggcatcaactggctctgctgcatctgcgccatcagcgcaaaacagaactcgccgccctgggccagggccaggccactgcgccaggccgtctcgccgtcgctgccgcgcagcttgagcaacagtgccaccacggcgcccttgatcagcatcagggccagggtcaggccgaggaccagcagggcatggctggcgaacaattgcaggtcgatcagcatgccgatactgacgaaaaacagccccagcagaatgtcgcggaacggccggatatcggcctcgatctggtgccggtagcggctttcccccagcagcatgccggcgaggaacgcaccaagggcgggggacaggccgagcaggtgggtcagccaggcggtcagcaagacgatgaccagggccagcaacacgaacagctcggcggaatgggaggcggccacctcgtggaacagccgtggcagcagccagcggctggccagcgccaggccgatgaacagcagggcggtcttgcccaacgtcaggggcagggcccagtaccaggcctgttcggtgtcgccggcgaataccggcaccagggtcagcaacagcacggctaccacgtcctggaacagcaacacgccgatcgcattctgcccgtggctgctgaagatttccccgaggctgcccagctccttgctgacaatggcggtggaggacagcgccaggcccgcgccgagcagcagcgccgggatcagcggtacgccggcgagaatcagcaggccgccaaggacggcgccgctgcacagcacttgcaggctgcccaggccgaataccacttggcgcagggccagcattttcgatacggaaaactccagtcccagggaaaacagcaggaacaccacccccaactccgccaggtcaggcaggttttcgttgtcgttgacccagccgaaggcggtcggccccaccagcaggcccacgcacaggtagcccagcacgggcggcaggcgcaggcggcggaacagggcaatcaccaccagggatgaagcaaggatgatcaacagattggcgaacacagacatctccggcggcgggttggaatacagagcgtagaggcaaaaaaagccgcgagggtcgctcaaccgcaagttggtggcgctgacctgcatcagctgtttggcagaatgctcgacgatggccattgttggccgcagggtattgcgttcatcggtcgacggctttttcccgcgggcctagaataagcgcctgtctcttttcggtctgtctgtcatgcctcctgaatgtcagctgttcggcaccctgggctgccacctgtgcgaactcgccgaggcggagttgatgccgctggtggagcacgggctgatggtcgagctggtggatatcgcggaaaacgaaaccctgttcgaggcgtatggcctgcgtatcccggtcctgcgccgggtggacaacggcgccgagctgggctggccgttcgatgccgagcaggtggtggccttcctgcgctgagccggctgtcgctggcacgaccctttccgtttgtcgcctgcgctgcaatcccttggcgggatcccgattattcggttactgtatatgcgtacagttatcgggatggttcgtcatgtctctcacaatcctcgcccgcgccgagcgtttgcaacacctgtcgcccgagcatgcagggcacgacgggtttgccgccgggctcacgttcgaaggcggtttttccctggatcgcactgtggggctcggagcgccgcagatccgtgcggtgctggtggatgacgacagtctgctgggcttcgggatctatcccggcgaccggctgatcgtcgatcgttcggcggccccggcggtggatcagtacgtggtggcccatctcgatggcgaagacgcctatggcgtgcgcctgctggcgcccgatcccaagggtgggctgctgctcaaggcggcgcgaccttcggttgcaccgatccccctggacgatcgggactcggcgcaaatctggggcgtggtgttgtgggtggtcagttatgtcggtcgtggctgatatcgaggcgcagggcgtgtgctcagtggatgaatgagagggtagaaggactgatgatggtcaatgtcgaacaattgaagagcagtgtgaaccgcatgtccgccgatgtggtgcgcgaagcggtactcgagctgcgcctggacggcctggtcacggaaggcaagacaccgttcaacaagctgcatttcaatacctgcttcgccgaaatcgaagccctgttccagcgtgcgggttatcaccggcaactggacgtggtggggtatcaggggttgttgtatgcgctgtatgacccggcccgctgggaggcggtcgatgtgctgcgctggctgaaggagttcaccgatgccgccgcgcaagccggcgtggcccgggcttagtcgcaggttccggagggggaaactctcctaggctccccgggacccatgttggataatgtcgctctgcattgtccgctcgagcttttgtatgtcttccgtacctttttttgccgcacagcatcaggccagcaccctgtacctgccccccggttcatggccaaccgtactggattgcctgtgtgaccatttcagcaccatcagccgcgagcagtggctgagccggatcgcccgcggccgggtgctcgatggacagggactaccgatcggtgtcgacctggcgtaccgcgaaggcctgcgcattcattattttcgcgaagtgcccgacgaaaagatcatcccggtgcaggagtcgatcctctacgtcgatgagcacctggtggtggcggacaagccgcatttcctgccggtcaccccggcgggggaatatgtcgagcaaaccttgctgcgccgcctgatccgcagcctggacaatccccacctggtgcctctgcatcgcatcgaccggcatacggcgggcctggtgttattttcggccaatccgcaaagccgctcggcctatcagtcgctgttcccgacgcgcaggatcgacaagcgctacgaggccatcgcaccggccttgcccggtcttgaattcccgcgggtgcataaaagccgcctgatcgatggcgagccctttttccgcatgcaggaagggcctggtacgcctaatacggaaacggcactggaggtccgggaaaagaacggtgacctctggcgttatgggttgtatccggtgaccggcaaaaagcaccagttgcgggtgcacatgagtgtgctgggggcggcgatctgcaacgatccgttttatcccgatgcgctcaaggatgtggaggacgattacgccaagccgctcaagctgctggcccaggggctgcgttttaccgacccgctgacaggggaggagcgcgagttcgagagtcggatcaccttgcagtggtaatccaggccactgcttgctgttgccagaaacgataaagcccgcgaaagcgggctttatcgttcaaggcagtaacggtatggattacagctcttttaccgtacgaacctgatccttgttgatgcgggtttgtttgccgtccagttgttcgaactcgtagaaaccggaatcctcatcgtatttcggcgtatcgacggcctggatttcgcgaccgtcattcagggtgatcacagtaggcgatgcgcaaccggcgagagtggcaaggcccagtgcaagcatgagagtggcgagagtccgctgaatcattatgtgtctccgagatgaatacttttagttgctgtgcttgagacgtatacaacgcctgcaagttccttgagttaagggcattctgacacgccgtgctgctggcttaacagctctggtgtattcagattagccaatcggggatcgtttgccggacattgcagggcctgagcatccagcccgcgcatgatacgtccggggctgcgctcaccgttctgccaggctccgtcgaaggtgccgagcagcgtgcgcggaatgatacacagcaagggttcccagtgctcgccatggcgcagcatcagcggtttgtccggatgcagggcggcgctttgtcgcatggcgtcgatcagttgcgcatcgatgcgcggcacgtcgcagggcaaccccttgtcccttccgcccatgcgttggccgcgtccaccggccaggagcagaatggagcagggcagcaaatctgcgcgctgggtcatggcacgtctccacaggggcgggcaaagagagcgctgtgatataacaccgggctgtttctcctacaactggatcgagcctatgaaagccaaggctgatgtaccttttgcacccctgaacatcgcggtgctgactgtcagtgatacccggaccctggagaccgatacctccggccaggtcttcgtcgatcgtctgagcgctgctggccataacctggccgcgcgcgtcctgctcaaggacgatctctacaagattcgcgcacaagtggcgacctggatcgccgacgacctggtccaggtggtgctgatcaccggcggcaccggtttcaccggccgcgacagcaccccggaagccgtgtcttgcctgctcgacaaacaggtcgacggctttggcgagttgttccgccagatctcggtcgccgacatcggcacttccaccgtgcagtcccgggccctggccgggctggccaacggcacgctggtgtgctgcctgccgggctcgaccaacgcggtgcgtaccggttgggacggcatcctcgccgagcagctggattcgcggcaccggccgtgcaatttcgtcacgcacctgaaacaggcagcgccttgtgaatcccgtgggtaagccgggcaagaccggtgccctgatgccggtcgaggtcgcattggcccgtttgctggagatggccgaggctactcccattctcgagcgcgagcggctgccgctggcgacggctcaaggccgggtcttggccgacgatttggtttctaccctggatcttccgccctggcccaacagcgccatggacggttacgccttgcgtgccgcggattggagtggtgaggcccttgtggtcagccagcgcattttcgccggccaggcgcccgagcctttggcgcccggtacctgcgcacgcatcttcaccggggcgccggtcccggcgggagccgactgcgtggaaatgcaggagaatgccgaggttcaggccgatgggcgggtgtcctttaccgagccgctcagcgccgggcagaacattcgtccccaaggccaggaaaccacggtcggcgagtgcgtattggtggccggaacgcagctggggccgatcgagctggggctcgctgcttccttgggttgcgcggagctggaggtggtgcgtcgagtgcgggtcgccgtgctctccaccggcgacgagctagtagaacccgggcaagcgctgggtcccgggcagatctacaacagcaaccgtgtcctgctgtgcagttggttgcagcgtctgggctgtgaggtggtcgacggcggcatcctgccggacgacctgcctacgacccggcatcgtcttgccgagctggcggatgtggatctgatcctgtccaccggtggtgtatcggtgggcgaggcggatttcctgggcatcgccttaagagaagagggcgagctggccctctggaagctggcgatcaagccgggcaaaccgttgaccttcgggcatttccgcggtgtgccggtgatcggcctaccgggtaacccggcctcgacactggtgacctttgccttgctggctcgcccctatattttgcggcgccagggagtgaaggagctgcagcccttgcagttccaggttccggctggatttgcctggccgaagccggggaaccgccgagagtatctgcgtgggcgcctggaacagggcagggcaatcatctatcggaaccagagttccggggtcttgcgcagtgccgcttgggccgaggggctggtcgaggtactggaagagcgaacgctggttgagggcgattgggtcaacttcattccattgagtgaagtcctgggctgactccaggggaggtggacctggtcggcagcgccgggtccatcctccagagccccacccatcaacgcaggagtaaaaggatcagcaagccaaaacggctgttcagtccccaggacagcagtgccgatataaatccggcataggccaacacccacgcgagcttcttgagcaaggcatgaagcttgctgtcgggcttatgctcggggtcacgggtatgtacttgatggacactcagttccgggtgtttgcctgtactgagcaggatgctcccttccagtcgagtgagcgcggagttcgagcgttcaaagcatttcttgtcatccatgtgtttcgcttccctgtttgaggcgtcgttcgcctgccatgaacattctccgattgtctgtttcgggtcaattcaggtgattctcaatctgcggtcagaaaagttaccggtcagccagcagacggcctgacggcgacaaattgattacatcccgatcggactttttctcatgggctgagggtcaacatccttcaatggccctcgaatgacaggagtgatgagcgatgagcgaacgcaaggcgatgctgatactgcacggcaagcaggccctcaacgaagaggtccgcgcggctgtcgagcgcaagcgtgaagagggttgggagctggcggtccgcctgacctgggaagcgggcgacgcccagcgcctggtggatgaagccctcgtggccggttacacccgcctgatcgcgggaggcggtgatggcactttgcgtgatatcgccgaggccatggcggcgcaggccaacgatgccagcctggtgttgctgccgctgggcacggccaatgattttgcgcgggcggctggcgtgtcgttgctgccccatgaggcattgaacctgctcgacgtgccggcacgggcgatcgacctcggcgaggtcggtggccaggtatttctcaacatggccacgggcgggttcggcagtcaggtgacggccaatacctccgaggacctgaaaaagattctggggggcgcggcctatctgttcactggtttgtcccgtttcaacgaactgcatgcggcatacggtgaactgcaggggccggatttccattggcgcggcgagttgctggccctggggatcggcaacgggcgccaggccggtggtgggcatctgctgtgccctgaggcgatggccgatgacggattgctggatgtcagtatcctgccggccccccaggagctggtgggcaccttgaaggacctgctggccggcggctggggaatcgacaacctgtttgtgcgcacgcgcctgccctgggttgaaatcaaggtgtccgaggggctggacatcaatctcgacggtgagcccctgcaaggcgaaaacctgcgttttcgcgcgctcccaggggcattgcgggtgcatttgccggaagactccccgctgttggcggcttcggcgtcttaatcgtcgaggctgatgatctgttcgcggacggcaaacaggaccaggccggccacatcatagatctgcaggcgtttcatgatctgcgagcggtgggtttccacggtcttgatgctcaggcccagcccatgagcgatttcgcgggtcgatttgccgcgaacgatcaggcgcaggatctccagctggcgtgcggtcaggttatgggtttcaacgggttccggatggggcttctgcacgcggatcagcgcctggttgatcaccgtgtgggcaatggccgggctgagataacgctcgttgttgcgcaaggcgtcgagcgcgtgctcgagctcgttggcggtggtgtccttgagcagataaccatgagcaccggattccagggcctgcatgatcagcgccggatcggtgtgcatcgagagaatcagtactttgctctgcggatgcaccaccttgagtctcttcagggcttcaaggccgccgatatccttcatggaaatatccagcaggataatgtccggcgacagcctctcgaccatttccagtacttgtgcgccatcgttggcttcaccgatcacggcatagccaggaatgtccatgaccagggcacgcacgccagccctgatgagcgagtggtcatccaccagaagtaaattgcaggtcaatgtaaaaccttattcgtactggcccgttcgagtgcgcgaggcgcccaggggaagagtgcttcgatttgtgtgccctggtcgggctggctggaaaccttcagggtgccacccagttgcgcgattctttccgccatgcccgccatgccgcgttgtccttgcgcgccaggattggccgccggggaaaagccacggccatcatcgctgataaacagcgaaaggccctcgggcaggcgttgcaggcgtaccagcaggttatccgcctgggcgtgacgcagcatgttggtgacggcttcttgagtgatgcgaaaggcggccaccgccatctcctcggggatgcctgccaggcgttgcttgcattccaggctccagtgcacggaagtgttttccagggtcttcagcaagtgtgcccgcaggctggcttccaggcccaggctggccaattgccggggattgagaatggccgatacatcgcgcaccttggccagggtttcttccaatgtgctttgaagcgtcgtgcaatgctgttgcaggtcttcgggcaggcggcgcttgagccattcgctttgcagcttggcggcagtcaacagctgaccaatatcatcatgcaattcacgactgaggcgatggcgctcgttttcctggacttccagcaagcgatccgccagttcctgaggctggaacttgatcgatttgcgcgaatcgccgtaataggcccagacactggccagggccaccagattcaggatcagcaggctgaggggaaaggtcgtcgacaggcaatagacagccagacttccaagtgccgagcatgagcacagcaacaggttgagccagcgcaggtttattcgagagagaagtctggtggcagttgacttgaggctggcgtacatagcggatggagccaatgaatgttcgctgcggggagaccggtcaagtcgactgacgggccccggtttggaaaacggtattgtttgagtatgcggcttcaattaacgcggtctattcgttgggagcaagccttgcactgatcaggtgtgtaacaagatcaatctgaaatcacagtgccattaaggatgtcgtttagtggctggcatagtatcagcttagctaccgttggtcgcgcctctatatatgtccagcgggtcaggaatattgccttttgggacgtatgttccgattcgcttgttttaactggctccgctcaaacagtgactgtatctggccttgcgcgaacgggtaggcgagattcagagcacttgaagtctcgggactggttttatttagttgtgttagttggttctgtcgttaacaggcatgaaatattggataacgacatgatgctggtcaatgtcacgacatatctaacgactgaagttaggtattaacgacagggtctatgcgtttctcttggcgatcgaaaaaactttgaacgaattttggtggcaggacaggggggcgggcaaagggtcgatttgcacggcgagggattcgatgagagtggcctgttcgttgccatcgaggttcagttgcccggtcaccggatcgacgagttcaagctgccaggccatcaggctgaagcactccccgagagtgtcgaggatctgctcgttcatgtccggatgagggtgggagtgatccagcaacgcatgaacctggcgcgagaattcggcggtgctgcgcagcgccagcgcgtcggttttctcggcaagtttgagcagagtggacaacatgcaatcgatggcgtcctgatcgttcctgatcaggttgagatggttcaggcattcaacagacttggccaatagtgcttctgcctcaagcagaaagtcaggtgactggtgccactctttatcgtcgatcagcatgcttgtctccacgacgccacgtcagatgatggaatggtccgttttgtgagcggctgtaaggtattacgtcggttatgccgtgggatataggacgaatctgattggttctcaatggacgaagacgctgtgctggtgtttagtctgcaggcgacagactgccgagcacggtgtgtcggccacgcttggacagcggaggcgggggggctcgaaggggcaccagcccatcttcctgcgatcacaaacaaaagcctgactccattcatgcaatgagaatggcgtcacattaatggctattggatattgcgaatatcaggttggtcctgattgccggtaggggattcccttataaaggggaaccaagtgctgaaagcgaggtcgcggcgggagcttgggcggatgaaatcgcgaagccagtaaagcatgatgttaatgtgacatcaatgcctttgcatggcattttgtacgcgggtcaagattcggcgaatcgcgccgataacccgcgttagtgaattcatcagaacaagcccaggagtcattacatggccggcattctcgacacggtagatcaacgcacgcaactggtgggtgagaatcgcctggaaatcctcatgtttcgtctggccgggcgacagttgttcgcgatcaacgtgttcaaggtgcaggaagtcctgcaattgccaaagctgacgctgatgccccagcgccatccgttcgtctgtggcgtggtcaacctgcgggggcagacgctgccggtcatcgacctgtcccaggcgatcggcatgcggcctctggtgccgggccccaacagcaccatcatcgtcaccgagtacaaccgctcggtgcaggccttcctggtgggaggcgtcgaccgcatcgtcaacatgaactgggaagccatcctgccgccgccgaccagtgccgggcgccagcattacctgacggcgatcagcaaggtcgacgatcaactggtcgagatcatcgacgtggaaaaggtcctggccgaaatcgttccctacaacgccaaggtctcacgcgacaagctcgacgatccggtgctcgagcgtgcccgcggccgtgaagtgctattggtggacgactccaacgtggcgctgtcgcaattgcgcgacaccctgggccagttgggggtgaagatgcacattgccagcgacggcctgaaggccctgaagatgctcaaggcctgggccgataccggggtcgacatgaccgacaagctgctgatggtgttcaccgacgccgaaatgccggaaatggacggctatcgcctgaccaccgaaatccgcaacgatcctcgtctgcgcggcctttatgtggtgctgcatacctccctgtccggcagcttcaacgagtcgatggtgaagaaggtcggttgcgacaacttcctgtccaagttccagccggacaaactggtcgacgtggtgcgccagcgcctgatgctggacgaagttcccgcctgacgggagcattggccggagcgacgcctgcgcggcaggtgcttctttgattcgcgggccggctcgtataaggttgctttttttgtcacccgggagctagccatgcgtctcagcgcgctttatcgataccccttgaagtccggcaagggcgagtccctgcaacaggtcgcgctggacaggctggggctggagggagatcgacgctggatgctggtcgatgaacccagcggacgcttcctgacccaacgtgcggtcccgcacatgagccagctttcggcgctctggaacgccgagggagggctgaccctcagtgctcccggctacccatccctcgatgtgccactgcctggtgcggatgccccgttacgtggcgtgaccatctggcgcgataccctgcgcgtaccggatgccggcgacgaagcccatgcctggctgagcgacttcatcggcaagccgacccgcctggtacaggtccccccggagcgtgcgcgcaccactcaggccggttacggcaaggatgacgatcaggtggcctttgccgacggttttccgctgttgctgattggcgagtcctcccgggaagacctgtccagtcgtgtcggccgtcccctggagatgctgcgctttcgcccgaacctggtgatcgagggctgcccggccttcgccgaagatggctggaaacgcatccgcatcggcgatatcgagtttcgggtggtcaagccttgtgcgcgttgcatcctcaccaccatcgatccgcagaccggcgagcgcagcgccgaccgtgaaccgctggccacgctgcagcagtaccgggcgcaagaaggcggggcgatgttcgggcagaatctggtgaacgatggcattggccggctggaagtcggcatgccggtcaccgtgctggaatagtcggtggcgtagaaacgaaaaatgcccatatcgccagatacgggcattttttatcgccgaggatcagttcccggagggatcagccgcggtattcgcacaggtaggcggtgtcgacggccactttcagctggaacttgctgttggccggtacgttgaactggctgccggcggcaaaggtttcccagtcgttgctgtcaggcagcttgacggtcagggcgccggaaaccacatgcatgatttcccgttgagccgtgccgaactcgtattcgcccggagccatgacgccgatggtggcgggaccttcggccgtgccgaaggcaatcgacttgacggtgccgtcgaagtactcgttgactttaaacatgggcgattcctcaaaaaggggtcaaaaaggccggccagtatgcacaaggccttcagatgcgtcacctgttgcgcggacggatcagccgggaagaatcagaggcaataaacgcgccgtattacgggcatcttccagggcgcgatgctgctggccggtgaactgcagcccggccagttgcagcgcgccgttcaggcccagcggtcgttcgaggcggcgggccttggcgaagcgttgcttgaggttcatgtgcggcagttgggcgagggcgctgtgcagttgcgagcgttgccactcctgcagcagctgcttgcgatcgtagtcgccccagctggcccagccctccaggcgtgtgtgatgctggcccagccagcgttcgaacagcggccagacttcgctcaacggctgggcgccgtcgatctgggcctgggtgatgtgggtcaattcacggcagaacggcgtcagcatcggccgccgcagcgggcgcacgaagcgttggaaatgatccagttcacgcccttcgcggttcaccagggtggcgccgatctcgatgatttccatgtcggtcaccggccagcctccttcgtccgtggtggcttccagatcaattaccaaccagtggggcatcacaggctccagcttcaacatcccgatgaggcttgagcgtagccaaacccgacgtctgcgcctagcggcttattccacctccagcagaatctggcggtttttcacctgatcgcccaggttgacctgcagccgcttgatcacgccatcgatcccggccttcagcggatgctccattttcatcgcctccagcaccagcagcaattgccccttgctgacggtcgcgccctcgctgaccagtacgtcgactatggcgccgtccatgggcgccttgagcatgccgctgtgggcgccggcctggctggcgaccggtgcgtggctcaggtcttgaaggtgcaggctgccaggacgggtgaacagccagagctgcccggcttccagggtgtaggcgtagcggcggcggataccgtcgatggtcgcgcaggcccagcggccatccgcctccagcagctgtacctcgaagccttggtcggcgtgttgaatccgcagcgtcccggcctggttattcagttcaaggttccatacggcttcacccgagcccaggcgatagcgcagcggcacactggcgttgttgcgccagccggccagcgccgcgccgtgacgctgggccgcgtgctgataaaacagtgccgtggccagggccagttcggcgccgcttggcggttgcgggcacaggcttggatcgtcggcgaaatgttcggcgataaaggcggtgctgaattcgccactggcaaacccgggatggcgaagcaggttcgccaacagcttctggttgctcgccacgcccgtcagcaccgtgtcctcgaccgcgcgcaacagcctgcgacgcgcttcttcgcgggtggcaccgtgggcgatgagcttgcccagcatggggtcatagaacgggctgacgctctggccttccagcaggccgtgatcgatacgcacatcggcacccagcgccggttcccagcgccgtatctggccggtttgcggcaggaaatcctgctccgggtcctcggcatacagccgcacttcgatggcatggcccttgagttcgacctgttcctggcgcagcggtagcggttgaccggccgccacctgcagttgcagggccaccaggtccaggccggtgatcatttcggtgaccgggtgttcgacctgcaggcgggtgttcatttccagaaagtagaattgcccccgtgcatcgagaagaaattccacggtgccggcgccgacataactcaccgcccggccggccttgagggcggcctcgcccatggcctggcgcagctcggcggtcatcaccgggcagggcgcttcctcgacgactttctgatgacggcgctggatcgagcaatcgcgctcgccgaggtagatcaattggccgtggcggtcgccgaacacctggatttccacatgccgcggttcgatcagcgcctgctccagaatcaactcgtcgctgccgaaggcgtgcagcgcctcggagcgcgcggtacgcacctgggccagcagctcatcggctcgctgcaccaggcgcatgccgcgtccgccgccaccggcgctggccttgatcatcagcgggtagccgatgcgttcggcttcgcgttgcagggtcgcatcgtcctgttccgcgccctgataaccggcgatgcagggcacgcccgccgcgagcatcgccagcttggacaggcgcttgctgcccatcagttcgatggcctcggcgctggggccgataaaggtgatgccggctgcctcgcaggcgctggcgaactcggcgttctccgacagaaagccgtagccgggatgcagcgcgtcggcgcccgtgcgccgcgccgcgtcgaggatcgcctggctgttcaggtaggactgctggaccgccgctgggccgatgcgcaccgcttcgtcggccatccgcacatgcagagcatcggcgtcggcatcgctgaacaccgccacggtgcgataacccaaggcttgggcggtgcgctggatgcggcaggcgatttcaccgcgattggcgatcaggattttgctgaaggcgggcatgaggtggtttcctgagatcggtggtgttggctcgcgacggggctcatgaggcccacgccggtttgcgtttctgcacgaaggccatggtcccctcgatgccttcggccccggtgacagcggcgccgaactgttccgccgcgcgatcgagcagcggcgccagcggttcttcagcgctggccagcaacagggccttggtcgcggcgttggcctcgggcgcgcagcacagcacatgggccagcacctcatcgaggcgttcggccagggcctctgggccgtcttcgacaaaatgcaccaggcccagccgctcggcttcgttgccatcaaagcgcgcggcggtcagggccagccgacgggcctgggtcaggccgatgcgcttgaccacaaacggcgcgatctgcgccggcagcaggccgaggctggtttccggcatgccgaactgcgcctgatgatcggcgatggcgatgtcgctgacacaggccaggccgaagccgccacccaacaccgcgccctgcagcagcacgatcagcacctgcggggtgtgctgggcttcttcgagcagggtgccgaacgcccggttcagttcctgataggcactggcgccctgggcccgggcattggccatgtctttcaggtcgccgccggcgcagaagtgcccgccggcgcccctcaggaccagggcgcgaatgccgcggtcatcgcgtaccgccgccagcaccgcgcgcagttcggcgaccatgtgcaggctcatggcgttacggctgtccgggcgatcgagggtgatgtgcaggacgccgccacggggcgccagcagcagggtttcgcaggcgggcaggcggctcattttcttttccccggcaggatgcccatgagtttgcagatgatgcccagcatgatttcgtcggcgccgccgccgatcgaaaccaggcgcacgtcgcggtaggcgcgggccaccgggttgtcccacatgaagcccatgccgccccagtattgcaggcaactgtcgctgacttcgcggcccaggcgcccggccttgagcttggccatggacgccaggcgggtgacgtcctggccgcgcacgtattgctcggtggcctggtacaccagggctcgcaggcattcgatttcggtggacagctcggccaggcggaagtggatcacctggttgtcgatcagcgcgctgccgaaggtcttgcgctccttgcagtactcgatggtgctgtcgacgcagtactccaggcccttgatcatgttggccgcgccgaacagccgctcttcctggaattgcagcatctgcatcatgaaacccgcgccttcgtggccgatgcgatagcgctggggcacgcgcacgttgtcgaaaaacacctgggcggtttccgagctgcgcatgccgagcttgtccaggtgcgggctgaggctgatgccggggctgttcatcggcaccatgatcagcgacttgttgacgtggggcttgtcgtccgaggtgttggccagcaggcagatgaagtcggcgctgggggagttggtgatccacatcttgctgccgttgatcacatagtcgtcgccgtccttgcgcgcggtggtcttgagcccggccacgtcggagccggcaccgacttcggagacaccgatgcagccgaccatttccccgctgatggccgggcgcaggaactcctcgcgcaactcgtcggagccgaaacgcgccagggccggggtgcacatgtcggtctgcacgccgatggacatcgggatgccgccgcaatggatggtgccgaattcttcggcggcgacgatcgagtagctgtagtccaggcccatgccgccgaacttctccggcttggagatgcccagcaggcccagttcgccggccttgcggaaaatctcgtggataggaaagcgtccggccttttcccattcctcgacatgcgggttgatctcgcgctcgacaaaattgcgcaccgtgcgccgcagttcttcatgttcctgggtgaagatcatttttattgttctcctcaagttgagtgacgcaatccctgaaccttgttacccctgtagccgctgccgcaggccgaaaacaccgtcgttgcggaactgctcgctgtccctgtagccgctgccgaaggctgcgatcggccccgcaggggacgtgcccttgaggccctcgaaggcccttcgggccttatcgcagcctgcggcagcggctacaggtcagaagcgtgcgacgccgaagctattgggttgtagctgacgcacctgcgcctcgtggcagatatccagcagataacccagcagggtgcgggtatcccgtggatcgatcagcccgtcgtcccacaggttggcgctgccatacaaggccgtggactggctgtcgagtttctgcgcggtgacctgttccagcatatccagcatctgcggatcggccgcctggccctgcttggcgtgcttggcctcggtgacgatgcgcagcaccttgccggcctgggcgccgcccatcaccgcggtgcggctgttgggccaggcgaagatgaagcgcgggtccaggccgcggccgcacatggcgtagttgccggcgccgtaggagccgccgaccacgatcgtcagcttcggcacccgggcattggccactgcctggatcagcttggaaccgtgcttgatcacaccctgctgctccgactcggtgccgaccatgaaaccggtggtgttgtggaaaaacagcagcggcgtgccgctctggtcgcacaactgaatgaactgcgcggccttgctcgcgcctttcggggtgatcggcccgttattaccgataaaaccgcaagggcgcccctggatatgcaggtggccgcaaagggtctgctggtcgaactcgcccttgaactcgaggaagttcgagccgtcggcgatgcgcgcgatgatttcccgggcgtcgtacggcttcttcgggtcgtcgggaatcagccccagcagctcgtcgatcgggtacagcggctccgcataaggccggggtggctgcagcggcagccgggcattccacggcagggcgttgagaatttcccgcacgatgcgcacgccgtcgccgtcgttttccgccaggtattcggcggtgccggccacctgcgcatgcatctcggcgccgcccagttcttcatcggtggccacctcgccggtggcggccttgagcaggggcgggccggcgagaaacagcttggccttgccgcgcaccaccaccacgtaatccgacagccccggctggtaggccccgccggcggtggccgagccgtggaccacggtgatctgcggcagacccatggccgacattcgcgcctggttggcgaaactgcgcgcgccttcgacgaaaatctccgccgcgtaattgaggttggcgccgccgctctcggccagggtcaccaccggcagtttgttttccatggcgatctgctgcaggcgcagggattttttcaggccgctcggggagatggtgccgcccttgatcgcactgttattggccaccaccagcacccgcacgccactgacgtaaccgatgccggcgatcaatccgccaccggcctggctgccgtccttgtcgtcgtgcagcttgtagccggccaggctcgccagttcgagaaagggcgcgccggggtcgagcagcagattgaggcgttcgcggggcagcagttgcccgcgcttttcgaatttcgccttggcctcggtggccttggccagcaggttctgttccagctggcggatctgcgcgatgccggccagcatcgcttcgcggttctgctggaactgcgggccgtggggatcgagctgggactgtatgactggcatggcttatttcccgtccttgagtggctcgtccttgagcacgtccggcaggtaggcgcggtggaagccgttataggactcgctgtgggacgccttgtgcagcggccaggcacggctgccgaggctggcggcgccgtcgatgcgcaaggtgctgccgctgatgaaggccgccgccgggctgagcaggaagacgatggcggcgctgacttccgactcggtgccgatgcgcttgagcggcacgtgttcgcgcagggtcgggatcaccgccttgaatgcgccttcgtaggtgtccatgccgctggaggcgatccagcccggcgccacggcgttgacccgcaccccggcatgaccccattcgaacgcggcggtcttggtgaaattgtccatccccgaacgcgcggcgccggagtggcccatgccgggcatgccgccccacatgtcggcgagcatgttgacgatgctgccgccgtgcttgctcatggactggttgaagacttcccgggccatgagaaaaccgcccaccaggttggtgcgcagcacggtttcaaatcccttctggttgatcgaggccaggggcgaggggtactgcccgccggcgttgttgaccaggccatgcagcggcccgtggtcacggatcagttcgctgaccagggccttgaccgcgtcctcgtcgcggatatcgcaggcatgcccgctggcctggccgccgtcttcggcgatctccgcggccaccttgtgcagcttgtccgccttgcgccccaccagcagcacacgggcgccaagggccgccagttcatgggcggtgcagcgcccgatgccgctgccgccgccggtgacgacgatggtctggccggcgaacaggtcgggtttgaaaatcgagtcgtagcccacgaaaagcctccttcagttgacggcgtcggcgatgctctgtggcaccgggatctggatttccagcaactgctgggcgaaggccttgccttgcgggtcgatgcgcaggctggcgacaccgccgccaccgagggcgttctccagcaggaaattcaggctgtgggtgcccggcaggtaccagcgctggacccggccatgcactgggtccagcacatggctcatccagtccaccacgacggcgggtgtcagggcctcggcgatccacggcaagtattcgggggcgcgggccatgaccccgatattgctgtggttgcccttgtcgccggagcgcgccaccgccagcttgaccagcgccacgctggcatcggcgcggcccacggggctggccacggcatggggggcgggcagggcgctggcgtcgaggctgtcgagctcgggcagttcgacccggtggtgctggccggccatctcgacttccagggtgcaggcgtttttgtcgatcaggaacgagaacaggcggatcagcggatagaccgtgggccggccgccgacgatgccggtcaggcccggggccatgccggtggctgcctgggcgatctcccgggaaaacagtaccagcgcgcgtttgtccggatggcgcacggcgagcttgatcaccacttcgcggctgtcctggcgctggccgtgggggccataggtggcttcgctgccgagcagttcgatattgacttcgctgtagggcgcccagccgcgttggccgaacatttgcgtggtcttgtcgatgatcgcctggctgacccggcgcgccttggccaccgcgtcgatgccggcgatcaggcaactggcggtgcagcggaaaccgtccgggtaagtggcgctgaccttgtactggccggtcggcggcaggcccttggcgccatgcacgctgaccgcattcttgccctgttggcgcagcttgacctgggtgaagtcgcagaccacgtccggcagcagataggcccgtgggtcgccgatctcatagagcagttgttcgccgacagtcagcgacgtgaccaggccgccggagccttcgggcttgctgaccacgaactggccatcggcgctgacttcgacgatgggaaagccgatgtgttcgtagtccggcacgtcgcgccagtcggtgaagttgccgccggtgcactgcgcgccgcattcgatgatgtgcccggcgagggcggcctgggccagtttgtcgtagtcgtgccaggaccagccgaattcatgcaccagcgccgcgctgaccaccgcgctgtcgaccccgcggccggtgatgacgatgtcggcgcccagtttcagggcttcgactatcccgggggcgccgaggtaggcgttggtggacacgcacatcggcggcagcggcgcaccgctgaacatttcatgaatgccgctgccgctcagttgcttgaagcaaggttgcaggtcgtcgcccagcagcacggcgattttcagggccacgccggcctggtcgcaggccgcttgcagggccgcggcgcaggcttgcgggttgatcccgccggcgttgctgatgacccggatctcctgccgggcgatctcgcccagcagcgggctcaagacctcgacgaaatccgtggcgtagccggcagtagggtccttcatccgcgcgccggccatgatcgacagggtgatctcggccaggtagtcgaacaccaggtaatccaggcggccgccctgcaccagttgcgcggcggcgctcgaggtgtcgccccagaaggcgctggcacaaccgatgcggagggtcttggtcatggctggggctctcgataaaagactcgataaaaagacgcgatgacagaactggatcgagactaccaagcaagcgcttggtttgtaaatgtcggaaatatcttattcccaagcgcttgcttggtcgtccccgcgggcttaaattgcgcgcgcaagctccctgtttcagggggctgcgccgcataacgatcgagcgaatgtaggagagaggccgtggacgagcaaaaagccttgctggtgatgcgccagctggtcgccaacgggcaactgaccgatccggacagcgcccgcggcaagctgctgcaaaccgcggctcacctgtttcgcaacaaaggctacgagcgcaccacggtgcgcgacctggccggcgcggtgggcatccagtccggcagcatctttcatcacttcaagagcaaggacgacatcctgcgcgcggtgatggaggaaaccatccactacaacaccgccctgatgcgcgccgaactggccgaagccggcagcgtgcgcgagcgggtgctggcgctgatccgctgcgagctgcaatcgatcatgggcggcagcggcgaggccatggcggtgctggtctacgaatggcgctcgttgtcggcccagggccaggccgacgtcctggcgctgcgcgacatttatgagcggatctggttgcaggtgctgggcgaggccaaggaggccggctttatcaagggcgatgtgttcattacccggcgttttctcaccggggcgctgtcctggaccaccacctggtttcgcgccgagggcagcatgaccctggagcaactggccgaggaagcgctgaccctggtgctcaaggagccgtaggcctcctgcaagtaattaattattcagtggaaagttgtcgaagccagggaaaccgcctagctttaatggcgttgccctgtttcttttcttgaggtgagttgccttgatgtcttcgccaatgcggacggctttgcgagtgctggtgtggggcctggccaccctgacggtttttccggcctgcgctgcgcagttggtacgcgtgggggcggcgcattttcccccttataccgtgcgtcccgagcagggcgccgacaccgggctgctgccgcaactggtggacgccttgaacgcgttgcagagcgactaccaattcgtactggtgccgacctcgattccccggcgttttcgcgatttcgagcaaggtcgcgtcgacatggcgattttcgagaacccggcctggggctggcagaacattccccacaccagcgtcgacatgggcctggaagatgccgaaatcttcaccgcccagcgcgagcccggccgcggccaggagtatttcgccgacctcaagggcaagcgcctggccctgttcagcggttaccactacgcgttcgccaacttcaatgccgaccccaagtacctggccgacacctacaacgcgaccctgacctattcccacgacagcaacctgctgatggtgctgcgcggtcgtgccgacattgcgctggtgacccgttcctacctcagtgatttcctttcgcacaatgccgacacggcgcagcaattgttcgcctccgagcggatcgatcaggtctaccaccactacgcgctgattcgccccatggcgccgatcagcggcgaaaacttcgccaagttgctggggcgcctgcgcgacagcggtgaattgctgaagatcttcgatccctaccgcatcgtggtcatgccaccggccaaatgaagccgcccccaaggcggcttgcctaaatttccctgtgcggctcacgtcacttggttgaacactgatgacgctgagtccgtgccatgtcctctctcgatacgctgtccgctgtggccgttgccgatccctgccgttgcgccgccgatcccgctggcctgcaaccgctgcgcctggccggtattgaaaccagcggtgccggccgcgggcctggcacgccactgccaccggcgggcagcgaggtgctgcaagccttgcgtgggcaagaaggatggcgtgacgagtggatggccggctggttatcgaccctggtgcattcgttatgcctcgaccacgggccgcgcgaatggctggccgaggacgctggccagaggctcgagcagcaggagcgttgcctgcattgtgggagagccttcgatttttcccacaagcgcgccgccctgctgattctggcgcaggggcggggtgtcggacggcatcaggcggtcgagaagatctggcgggagcgttcctgttcgcggtagcgccgtggctgacggtggctatcgcgatcaggtgcgggaatagcgtgcggcgcggatcagtgacgggcgtaggtgtcggcgcggttgcccgagactttgcggcaatgcaccagcgcatcgcgaatcatgaaattcaccagcgtcggcgagaccccgagttccttggcgatgtccttttgcggcacgccatgcaggcgatacatctcgaacgcatagcgggtgcggctgggcagctctgtcagcgcgtcggcaatgtgttccagggtcgagaaattgatgtgtgaggtttccggcgacgctccctgcacgaccacattcagaccctcttcttcagtgcccgaatacttctgctccagcgcctgcttgcgatagtggtcgatcgccagattgcgcacgatctggaacagatagctcaactgcgccttgaacgacgaggtgatctgcggcgccgattgcagccggaagaacgcgtcttgcaccacgtcttcggcacgggaacgacagccggtaatacgcgccgcgatcttgaccaggatcaggcggttgtcgacgaaggcctggagtagcggtgaatcgcacctgcttgtggatacttgttccgtcatggaaatcaccttgctgcaaaagggttagtaggacgacagaaatttcagattcgtcttacacatcgagcgacaaattatgttgaatgataatgattgtcaattgagaaatagaattaatgagcatctttggtgcagcgcgagaactgcggctcgttgtcgcactttgtgaagggggtcgagggcagagtgcggactaattatttcaagacgccatccgttctcattggagaaaggttccgggtggaacatcccgccacagcgctctccagatgtcccattccgagggcagtggcctttatttttcaaaggtttatgtaacggtcgcggccttttcccgcggctctacgtgcaagcacaatccgcgcaggaaaccccatgatggacgcgttcgaactccccagcactctggctcaagcccttcaacgccgggcggctcagacccccgatcaagtggccttgcgcttccttgccgaagagcaggatcagagcgtggtcctcagttatcgcgacctggatttgcgtgcccggaccatcgccgcggcgctgcaggccaatgccggcttgggcgatcgcgcggtgctgctgttccccagcggcccggactatgtcgcggcgtttttcgcctgcctgtatgccggggttatcgcggtgccggcctatccgccggagtcgagccgacgccatcaccaggagcggctgatctcgatcatcgccgacgccgagccgcggctgctgctgaccagcagcggcctgcgcgactccctggcgcagatggacgaactgcaaggcgtcgacgcgccgcaactgctctgcgtggatagcctggcggcgagcctggccgaaggctggaccgccaccgaactgcgcggcgacgacatcgccttcctgcaatacacctcgggctccaccgccttgcccaagggcgtgcaggtcagccacggcaacctggtggccaacgaactgctgatccgccgcggcttcggcatcgatctcaaccccgacgacgtgatcgtcagctggctgccgctgtaccacgacatgggcctgatcggcggcctgctgcaaccgatcttcagcggtgtgccctgcgtattgatgtcgccggcgtatttcctcggacgaccgttgcgctggctggaggcgatcagcgaatacggcggcaccatcagcggcggcccggacttcgcctaccgcctgtgcagcgagcgggtcagcgagtcggccctggagcgcctggacctcagccgctggcgcgtggcctattccgggtccgagccgatccgcctggacaccctggaacgcttcgccgagaagttcgccgcctgcggtttcaccccgaacaacttcttcgcttcttatggcctggccgaagccaccctgtttgtcgccggcggcacccgtggccagggcatcccggccttgcgcctggacgagcaggccctggcgcagaaccgcgccgagccgggcaccggcaacgccatgatgagctgcggcacccgccagcccgagcacgcggtgctgatcgtcgagccgaacacccaggtcgagctggaagacaaccgggtcggcgaagtctgggccgccggcccgagcatcgcccatggttactggcgcaaccccgaggccacggccaagaccttcgtcgagcatgccggccggacctggctgcgcaccggcgatctgggtttcatgcacgatggcgagctgttcattaccggccgcttgaaagacatgctgatcgtgcgtgggcacaacctttatccacaggacatcgagcagaccatcgagcgtgaagtcgaggtggtgcgcaagggccgggtcgcggcgttcgccgttaccgagcagggcgaggaaggcatcggcatcgccgcggaaatcagccgcagcgtgcagaagatcctcacgccggacgcgctgatcaagctgattcgccagaccgtggccgaggcctaccagcaagcgccgagcgtggtggtcctgctcaaccccggcgccttgcccaagacctccagcggcaagctgcaacgttcggcctgccgcaaccgcctggccgatggcagcctcgacagttacgcccagtttcctagttgccaagctgtggccggcgaggccagcggcgaagcgaccagcgaactgcaagagctgatcggccgcatctggcgcgaacagctgcaagtcgagcaagtagcgagcgacgatcacttcttcctgttgggcggtaactccatcgccgcgacccaggtcgtcgcgcgcctgcgtgaagcactcggcctggagctgaacctgcgcctgctgttcgaggcgccgacccttggcgccttcgccgcgcaggtcgcccagttgcaacaggatggcggcctggcccagggcgcgatcaacgccttgtcgcgcgccgaggcgctgcctcaatccctggcgcagaaccgcctgtggatcacctggcagcttgacccgcacagcagcgcctacaacattcccggtggcctgcgcctgcgtggcgagctggacgaagacgccctgcgcgccagtttccagcaactgatcgaacgccacgaatccctgcgcacgcgctttttcgagcgcgacggccaggcgctgcaacaggtcgaagccgccagcgaattcaacctgcaagtgatcgacctcagcgacctgccggcggccgagcgcgaggcgcgggcgcaacagatccgtgaggatgaggcccgtacccggttcgacctggaacaaggcccgctgctccgggtgaccctggtgcgcctcgatgacgaagagcaccaactgctggtgaccctgcaccacatcatcgccgacggttggtcgctgaatgtgctgatcgacgagttctcgcgcctgtatgccgctgccgtgcaaggccaggcggcgagcctggcgccgttgccgttgcagtacgccgactacggcagctggcagcgccagtggctggcccagggcgaaggcgaacggcaactggcctactggaaacagcagttgggcgatgagcacccgagcctggggctggccaccgatcagccgcgttcggcgcaacggcaacacagcgccgcgcggcacagcctgcgcctgggcgcgagcctgagcgacgccattcgccagaccgcccaggcccatgaatccacacctttcatgctgttgctcacggcgttccagagcctgctgcatcgctacagcggccagcgcgacctccgtatcggtgtacccaacgccaaccgtccgcgcctggaaacccagggcctgatcggcttcttcatcaacaccctggtgctgcgcgccgaggtggacgggcgcctgccgttcgttgagctgttggcgcagacccgccaggccgcgctgcaggcccaggcccatcaggacctgccgttcgagcaactgctcgaagccttcccccaggcccgcgaacaggggctgttccaggtcatgttcaaccaccagcagcgtgacctcagcgccctgcgccggttgcccgggctgctggccgaggagttgccgtggcacagccgcgaagccaagttcgacctgcaactgcacagtgaagaagatcgcaacggccgcctgagcctatccttcgactacgccgccgagctgttcgaggccgcgactgtcgagcgcctggccgagcattacgtcagcctgctgcgcgaagcctgtgcgcgtccgcagaccgccatcgccgacctgccgctgctcaacccctgcgagcaggcgcagcagcaacagtggagcgaagccccgtgcgcggcggccagccaatggctgcccgaactgctcgaggcacaactgcagcaggccccggaacgcaccgcactggtgtggcagggcggcgagctgagctttgccgagctgcatgcccaggccaaccgcctggcccattacctgcgcgacaaaggggtcggcccggatgtctgcgtggccatcgccgccgagcgctcgccgcagctgttgatcggcctgctggcgatcgtcaaggccggcggcgcctatgtgccgctggacccggactacccggccgagcgcctggcctacatgctggccgacagtggcgtcgagctgctgctgacccagacccacctgctcgagcgcctgccccaggccgcgggtgtcagcgccatcgccatggacagcctcaagctcgacagctggccgagccatgcgccgggcctgcacctgcacggcgacaacctggcctatgtgatctacacctccggctccaccggccagcccaagggcgtgggcaacacccacgcggccctgagcgaacgcttgcagtggatgcagaacagctaccgcctggacgccagcgatgtgctgatgcaaaaggcgccgatcagtttcgacgtgtcggtgtgggagtgcttctggccgctgatcaccggctgccgcctgctgctggccgcgccgggcgaacaccgcgacccgcatcgcatcgcccagttggtgcagcaatacggcgtgaccacgctgcactttgtgccgccgctgttgcagctgttcgtcgaggagccgctgagcgccggatgcagcagcctgcgccgggtgttctccggtggcgaagccttgccggccgaattgcgcgaccgggtgctggagcaactgccgaacgctcaactgcataaccgttacggcccgaccgaaaccgcgatcaacgttacccattggcattgccgcagtgtcgatggccagcgttcgcccatcggccgtccgctgggcaacgtgatctgccgggtgctggacgccgacctcaacccggtgccgataggcgtgccgggagagctgtgcattgccgggatcggcctggcccgcggttacctggggcgcccggggctgagcgccgaacgttttgtcgttgacccgctgagcagcgacggcgcgcgcctgtaccgcaccggcgaccgggtgcgctgggcggccgatggcgcgctggaatacctcgggcgtctcgaccagcaggtcaagctgcgcggctttcgcgtcgaaccccaggaaatcgaagcgcgcctgctggcccaggagggcgtggcccaggcggcggtactggtgcgcgagaccgcggccggtgcgcagctgatcggttattacaccgctacctccgatggggaagaggaagaagcgcagaccgcgcgcctgaaaaccgccctggccagtgagctgccggagtacatggtgccggcgcaactgatgcgtctttcggccatgcccctgagcccgagcggcaagctcgaccgccgcgccttgccggaaccgcaatggcaggtgcgcgaacacgtcgaacccgtcactgagttgcaacagcggatcgcggcgatctggcgcgaggtgctggggcagcagcgcattggcttgcgcgatgatttctttgccctgggcggccactcgctgctggccacgcagatcatttcccggacccgccaggcctgcgacgtcgagttaccgctgcggaccctgttcgaagccagcgagctgggcgacttcgccgagcaggtgcggctgatccaggaagccggcaagcgcaaccagcagccgccgatcgccaaggtcgatcgcagccagccggtaccactgtcctattcccagcagcgcatgtggttcctctggcagatggagccggacagcccggcctacaacgttggcggcatggcgcgttttgcgggtgtgctggatgtcgggcgtttcgaggcggcgctgcaggcgctgatcctgcgtcacgaaaccctgcgcaccacgttccccagcgtcgacggcgtggctcagcaatgggtgcacggggaaaccggcgtgcgcatgggctggaaggatttctccatgctggatgcaacggcccgcgagcaacgcctgcaacagctggccgacagcgaagcgcaccggccgttcgacctggaaaccggtccgctgctgcgcgcctgcctggtcaaggcggcggagcatgagcactacttcgtgctgaccctgcaccacatcgtcaccgaaggctgggcgatggacatcttcgcccgtgagctgagcgcgttgtacgaagcctttatcgatgaccgcgactcgccgctggaaccgctgccggtgcagtacctggattacagcgtctggcagcgccagtggctggagtccggcgagcgtcagcgccagctggattactggaccgcgcaactgggcaacgaacatccgctgctggaattgccgggcgaccggccgcggccgccggtgcagagccaccggggcgagttgtaccgcttcgacctgagcgacgagttggcggcacgggtgcggcgcttcaacgccgaacatggcctgaccctgttcatgaccatgaccgcgaccctggctgtgctgctctatcgctacagcggccagaccgacctgcgcattggcgcgccggtggccaaccgcatccgcccggaaagcgaagggctgatcggcgctttcctcaacacccaggtgctgcgttgccagctcgacgggcagatgagcgtctttgatctgttcgagcaggtgcggcataccgtgatcgaaggccagtcccatcaggacctgccgttcgaccacctggtggaagccctgcaaccgccgcgcagcgccgcctataacccgctgttccaggtgatgtgcaacgttcagcgctgggaattccagcagagccgcagcctggccggcatgaccgtggaatacctggccaacgatgcgcgggccaccaagttcgacctcaacctggaagtcaccgacctggaccatcgcctgggttgctgcctgacctacagcaccgacctgttcgacgaaccgcgcatcgcgcgcatggcggcgcactggcgcaacctgctggaggccttgatcgcggccttgatcgagagccccgagcagcgcttgagcgaattgccgctgctggaccgcgtcgaacaacagcagctgttggacagcctgggtgtcgagcccggcgaacatcgcctggaccagtgcatccatcacttgttcagcgagcaggcgctgctgcgcccggacgcgccggccctgacgttcgccgggcagaccctgagctatgccgagctcgacagccgcgccaaccgcctggcctggatgctccgtgagcgtggcgtcggcccgcaggtgcgggtcggcctggccctggagcgctcgctggaaatggtcatcggcctgctggcgatcctcaaggctggcggcgcctacgtgccgctggacccggaatacccgctggaccgcctgcactacatgatcgaagacagcggcatcggcctgctgctcagcgatgcggcgatgttccaggctttgggggagttgccagccagcgtggcgcgctggtgcctggaagaggacggcgcgcaactggccaactacccggccagcgagctgccctttatcagcctgccgcagcaccaggcgtacctgatctacacctcgggctccaccggcaagcccaagggcgtggtggtgtcccatggcgagatctccatgcactgccgcgcggtgatcgagcgcttcggcatgcgtgcggacgactgcgagctgcacttctattccatcaacttcgacgccgccaccgagcgcctgctggtgccattgctcagcggtgcccaggtggtgctgcgggcgcaagggcagtgggacgcgcaagaaatctgccagctgattcgtgagcagcgcatcaacatcctcggcttcaccccgagctacggtagccagctggcgcagtggctggcgacccagggccagaccctgccggtgcgcatgtgcatcaccggtggcgaggcgctgaccggtgaacacctgagccgtattcgcgcggcgttcaagccgagcctgttcttcaacgcctacggcccgaccgaaaccgtggtcatgcctttggccagcctggcgccggaacaactggaagagggcgccggcagcgtgccgatcggcacggtggtgggtgagcgcgtggcctacatcctcgacgccgatctggccctgctgccgcaaggcgccaccggcgagttgtatgtcggcggggccggcctggcccagggttaccaccagcgtccgggcatgagcgccgagcgtttcgtggccgacccgttcagcaccactggcgggcgcctgtatcgcaccggcgatctggtgcgccagtgcgccgacggccaggtggaatacatcggtcgggtcgaccatcaggtgaagattcgtggcttccgtatcgagctgggggaaatcgaaaaccgcctgctggaacatgacgcggtgcgcgaagcggtggtgctggccctggacatgccgggcggcaaacagctggccggctatctagtcagcgacgttgccgaacagagtgacgagcagcaggcggccctgcgcgaggcgatcaaggcgcagctgaaaatccatctgccggactacatggtgcccacccacctgatcctgctggcgagcatgccgctgaccgccaacggcaagctcgaccgtcgcgccttgccggccccggacctggaactcaaccgccagcagtacgtggcgccgagcaacgagctggagcaaaccctggcccaggtctggtgcgacgtgctgaacctgcggcaggtcggcctgcacgacaacttcttcgaactgggcggcgactcgatcctgtcgatccaggtggtcagccgcgcccgtcagctgggcattcatttcagcccgcgggacctgttccagcatcagaccgtgcaaaccctggccgcggtggccagccgcagcgagcggattatcgccgagcaaggcctgctcagcggcgagtcgggcctgacgccgatccagcactggttcttcgacagtgcgatccccgagcgtcagcactggaaccaggccctgctgctggcgccgacccaggtgctcgacgggcagttgctggagcgagcgttgcacgcggtgctggcccagcatgacgccctgcgcctgcgcttcacccaggtcgacggccaatggcgggccgagcaccagccgctgtccgaggcgccactgctgatgccggtgcgcgtggcttccatggagcaatgcccggcgttgttcgccgaggctcaacgtagcctggacctggccaacggaccgctgttgcgcgcgctgttggtggacggtccggatgcacagcaacgcctgttcatcgcgattcaccacctggtggtcgacggcgtgtcctggcgggtgctgctggaggatctgcaaaacctctaccgtcagcttgaagctcagcagacgccgcgcctgccggcgaaaaccagcgccttgcgcgattgggcgtcacgcctgcaggcctatgccggcagcgagtcgctgcgcgaagagttgagctggtggcaggaccaattggctggcccggcggcgacgctgccggtgcagcacgcccagggcgggctgcagaacaagcatgcgcagaccgtcagcgtgaagctggatgccgagcgcacccggcagctgctgcaacaggcgccgagcgcctaccgcacccaggtcaacgacctgctgctgacggccctggcccgcgtgctgtgccgctggaccggcgaggcttcggcgctgatccagctcgaaggccatggccgcgaaaccctgttcgacgagatcgacctgacccgcacagtcggctggttcaccagcgcttacccgctgcgcctgaccccgctggccatcgaagcggcggccgggcagggcgcctcgatcaaggcgatcaaggagcagctgcgcgccgtgccgcataaaggcctgggttatggcgtgctgcgctacctggccgacgcggcgatccagcagggcatggcggccttgccgcaggcgccggtcaccttcaactacctgggccagttcgaccagagctttgccagcgacgcgctgttccgtccgctggacgagccggtgggcgccgcccattcgccggaagcgccgctgcccaacgagctgagcatcgacagccaggtctacgccggcgagctggtgctgcgctggaccttcagcggcgagcgtttcgatgtgcagaacatcgacgcgctggcccaggcctacctcggcgaactgcacagcctgatcgcccattgcctggaggacgatgccggtggcctgacgccgtcggacttccccctggcacgcctgacccaggcacaactggacgcgctgccggtgccggccagcgccatcgaggacgtctacccgctgaccccgatgcaggagggcatgctgctgcacaccctgctggagccgggcaccggcctgtactacatgcaggaccgctaccgcatcgacagcgagctggacccggcgcgtttcgcccaggcctggcaggcggtggtggcccgtcacgaagccctgcgcgcgtccttctgctggaacgtcggcgaagacatgctgcaggttatccacaagcccggcagcacgccgatcgagttcctggactggagcgctgtcgcgcaagacgagcaggaaccgaagctgcaggcgctgctgaaaagcgagcgcgaggccggtttcgatctgctcagccaggcaccgttccacctgcggctgatccgcgtgggggccgcgcgctactggttcatgatgagcaaccaccacatcctgatcgatgcctggtgccgttcgctgttgatgaacgacttcttcgagatctacaccgccctgggcgaaggtcgcgaagcccagttgagcgtgccgccacgctaccgcgactacatcggctggctgcaacgccagagcctggccgaggcgcgccagtggtggaaaaacaacctgcaaggcttcgagcgcaccacgccgattccgagcgaccgaccgttcctgcgcgaacacgccggcgatagcggcggcatgatcgtcggtgactgctacacccgtctcgatgcccgcgacggcgcgcaattgcgtgagttggcgcagcagcatcagctgaccgtcaacaccttcgcccaggcggcctgggccctggtcctgcggcgcctgagcggcgagcgtgacgtgctgttcggcgtcaccgtggccgggcgtccggtgcaaatgcccgagatgcagcgcaccgtcggcctgttcatcaacagcatcgcgctgcgggtgcagctgcccgaagacggccagcgcctgagcgtgcgtcaatggctcggcagcctgctggaacgcaacatggagctgcgcgagtacgaatacctgccgctggtggcgatccaggaaaacagcgaactgcccaagggccagccgctgttcgacagcctgttcgtgttcgagaacgcaccggtggaagtctcggtgctggaccgcgcgcaaagcctgaacgccacctcggattccggccgcacccacaccaacttcccgctgaccgcggtgtgctacccgggggatgacctggggctgcacctgtcctacgaccagcgctacttcgagcaagcgaccatcgagcgcatgctcggcgagttcaagcgcctgctgctggcgctggtgcagggcttccatggcgacatggccgagctgccgctgctgggcgcagcagagcaggacttcctgctcgccggctgcaatcagagcgagcatgagtacccgctgcagcgcagctacgtcgaactgttcgaggcccaggtggcggtgcatccgcaacgcatcgccgccagttgccaggacttgcactacagctatgccgaactgaaccagcgcagtaaccgcctgggccacgccctgatcgccaacggcgtgggcctggaccagccggtggccttgctggccgagcgcagcctggacctgctgggcatgatcatcggcagcttcaaggccggcgccggctacctgccgctggacccgggcctgccgggccagcgcctggggcggatcatcgagctgagccgcacgccgttgctggtgtgtaccgcggcctgcaaggaacaggcgcgagccttgctggacgagttcgcctgcgccaaccgaccacgtttgctggtgtgggaagaggtgcaagcggccgatcattcgcaggacaacccggggatctacagcggcccggacaacctggcctatgtgatctacacctcgggctccaccggcctgcccaagggcgtgatggtcgagcagcgcggcatgctcaacaaccagctgagcaaggtgccatacctgcaattgagcgaagccgatgtgatcgcccagaccgcgtcgcagagcttcgacatttcggtctggcagttcctcgccgcgccgctgttcggcgcgcgggtggacatcgtgccgaacgccatcgcccatgatccgcaaggcttgctggcccatgtgcaggcgcagcgcatcagcgtgctggaaagcgtgccgtcgctgatccagggcatgctcgcccaggagtccatcgacctcaatggcctgcgctggatgctgccgaccggcgaggcgatgccgccggagctggcgcaccaatggttgctgcgttacccgcagatcggcctggtcaacgcctacggtccggccgaatgctcggatgacgtggccttctaccgcgtcgacatggcctcgacccgtggcagctacctgccgatcggtacgccgaccgacaacaaccgcctgtacctgatggatggcgcgctggacctggtgccactgggcgcggtgggcgagctgtgcgtcgccggtaccggggtcggccgtggttacgtcagcgatccgctgcgcaccgcccaggtgttcgtgccgcatccgttcggtgccccgggcgagcgcctgtaccgcaccggcgacctggcacggcgccgcgccgatggcgtgctggagtacgtcgggcgcatcgaccatcaagtgaaaatccgtggctaccgcatcgagctgggggagatcgaagcccgcctgcacgaacaaccggaagtccgcgatgcggcggtcggggtgcaggaaggcgtcaacggcaagcatttggtggggtatttggtagccagcgactcgccgctgaacccaacggaacgcctggagcgcatcaagcagcgcctgcgcgccgagctgccggaatacatggtgccgctgcactggctgtggctggagcgcctgccactcaacgccaacggcaagctcgaccgcaaggccctgccggccctggagatcggccagctgcacagccaggactacctggcaccgcgcagcgagctggagcagaccctggccgatatctgggccgaggtgctcaaggttgagcgggtcggggtccgggacaacttcttcgagctgggcgggcattcactgctggccacgcagatcgcctcgcgggtgcagaaaaccctgcaacgcaacgtgccgctgcgggcgatgttcgagtgcagcacggtggaggaactggcgcagtacatcgacggcctggcgagcagtgaaatcaacgaggagaaggtcgatcgcctgagcgacctgatggcggagctggaggggttgtaatccagggttgtcggcgctggccctatcgcgagcaagctgaactggcctgataatccgggacaccccaatcgggcgccatgcgcccaactctgcaccttcgcctggcagggccttaccatcgaggccctgctcacttccggctggcccgagtgctaccgtcacatccacggttatccgctgcccatctttgaaaccggctaccgctcccgcttcaaatgcgccgacaacatcgacgcggcaggcggcgcagcagatgtcgctgttctaaaaaactcggcccttcgggtcgaattattcatccttcaccgtgcgagattagagtccttcgcagaactgctcatggggctcgcaatgaaattttgaagtatctccgcgaccagggcgatttagtctttcacttatagtgattcgagttaatccatcttccaaatttgacttttgacgctaactttagtggctatgctcttacagtgggttgactatcaaagtcattgccacgccagcaataatggcagatcgttattttggagtttttatggacatggagctgtttgaagcgagctattaccaagcccccgagacaccaaaacgccattgatgttctgcttgcacgcctccagttatttcaacggctatgttttggagaattgaaatgtccaatgaaaagtttgaccgcgtaacagcgaatctgtctgttgccgatataagcactgcaatcgcgaccggtttgcaaagggcgctcgatactcgtggagaagcgttgcgcgataaaatccttatttatggcgggaggattgacttcaacattcaagtgctcccccaaggcgcggtaggcgaactcaaggaagttgccaatattggcaaggtctaggtttttcggcattttttcgtcaagccaatagggacagaaggaatgctggtggagggaataaaatgccacccaaatcgttggaaaaatcccgccgattgattgagaacgctcgaaataaggcgcttctgtgcccaagtgctcagccggaatgggaaggcgcgaaaatattcggggtggtgaatggcacggtggcagctcctgaagtagcttacctttcacaagcaatacccatgacgaaagagctggctgaatcaacagtccctgtcagtccggcagaggtgtttcgcatttccgcaccctgtgcggaaatgcgatgccagcattacaaggaaggaggctgccagcttgtatcacgcaccgtagagaaattaaaaacggtcacagacaaacttccccgttgctcgataagagcctcttgtcgttggtggaatgaacaggggccagatgcctgtttccgctgtccgcaagtcgtaaccaacagtttctcccaggacgagatgatcattattgcggcaaccccgatatagctcaaagtgtgagcctcgttgaagatgaaagaactctgatcaacgtgcactttctgatatgaactttgagtctattgaccacttctggaggggagttatatacatcgttcaggcgttcagcagcctttatggatttcatcatcctttgcaggtgcgagtttgctcgcgaaaaacctccaggcctgcacggcccttaggacttgtccgattgacggtaacccttcaccggcacagtctagcgaggctttttcgcagcccacctgacaggagacagttgatgcccttcgcgactattgatggacaagcccttcactacctggaccagggcagcggcccggcggtgctgctagccggcagctacctgtgggacctgaacatgtgggcgccgcagatcgaggcgctgtcccggcagtaccgggtgatcgccctggacctgtggggccacggccaatccggcgcgctgccgcaagacaccacctcgctggacgatatcgcccggcaggtgctggcgctgctggatcatctgcagatcgagcgcatcagcctggtcggcctatcggtgggcggcatgtggggcgcgcgcctggccctggcggcgccgcaacgcatcaatggcctggtgctgatggacagctatctgggggccgagccggagccgacccgccagtattacttctcgttgttcaagcagatcgaagagagcggggtgatcgcgccgcagctgctggacatcgtggtaccgattttcttccgtccgggcatcgacccgcagtcggcgctgtaccgggacttccgcgccgtgctcgcggcactgcccagcgaacgcctgcgcgaaagcgtggtgcccatgggccgcatcaccttcagccgcgcagacctgctgtcgcgcctggaccagttggaccccaagaccaccttgctgctgtgcggcgaccaggacaaaccgcgcccacctgcggaaacccgggaaatggccgagctgattggttgcccttatcagctggtgcccgaggccgggcatatctccaacctggagaacccggaatttgtcaccgaggcgttgttggcgtttttggcggagcggcattcctgctgacagtgcagcggccaccccccagccctctgctatagtcgcgcccggcgcaggtccaagcacctgcgccgggcgttttcattcagggacaggggcgatgacggaacacatttactggcgtgatatcgaggacctggccggcaattggaacggcctcggggtggaggtcaagcgcccggccagtggcaagccgaacttgcgcctgctcagtggccacaaccgacgcatgcaactggtgctgggtgaccagacgctgctctggggcaccatgtcccgctgcctttacggcgtgtggctggtacgcaatcacctgctggagcacttgccgcaaaccctggtggggcccatcgattcgccccaggtggagcaacagctacgcctcgacccggccctgcgcctcaaggcctggagccgcttcttcgtccagcagttgatgcagcaccagccggactttttctacccgggctactggctggtccgggccctgcgcccggaatccctcaagccgatgcggccgttgctgagcggcaccgaagcctggtacttcaagggcggtgaagacgccctgagccatatgccgcagtgggcgatctacggccgcaacatcctcgacaaccggcaacccggcgcggcgcgctgggtcgagttgggcgagagtggtggcgcggtggtcggcctgcatgcagtggacccgcattccgggcgcctcaaatggtggcgcaagaaagcccgcgaaagcagcttgccgcccatcctgctgtggtacgtcagcggcctgagttgccatctgattctcgatggccattaccgcttgcaggcggccatcgatgaaaaccttcccccggagttcctggtgctcagctcgccgcggctcttcagctatcgcccgaacccgcaagagcagcagaaggtgctgggggcgctgcagatgcagatccagcgcaagaacctggaaacggtgcgcttcaaccaactgctgatcagcaccttcgatgaccgtccgtatcacggcttcggcagccagtcgtgggccgggattgcctcggaaaaggtctgggtcgatcaggtcagcgccgtcctcaacgaacgggcagacaccggcgagctggagaacatcctcgcccgcgaagcgccggacgagttcgcctgagccttacgcacaagcgccgaatgctgacacgcccctgtagccgctgccgagcctgcgaggctgcgaggctgcgatcgggctgggcggcattccgacgaagcggccgcaaaccaggcgacggaatcttgcctgacccaccgcatgggcaggtttggcatcagctgcgcccgaacgcggaccgagccgatcgcagccctcggcaacggcttatgcacaggcgccgaactcagacacgcccctgtagccgctgccgaaggctgcgatcgggcgcgaagcggccgcaaaccaggcgacggttttttgcctgaccacctcatgggcaggtttggcgcctgctacgcagtcgatcgcagccttcggcagcggctacagtgggatgtttcgcgttcttttgtagggtctttccgagaagcagtttgccgcttgaatgtggttgttctgaggctctagtctgcgtgggtcatcgcgaaatcgatggccggatgtgcaagtccgaaaaacatatcaggaacgtacgaagacccagaagtaattgctgggtgttcatatccactgtgttgaggaccgcatccatgaaaaagccaattcctgcatatcgctaccctgagttgaaaaccgccaatcaaaccttgcgtcaggcactggccagttcgcctcctgaagcatttgattctctccatgccactacggcagggccggtaggtccggattctcttttctgtgtacgcgaaggcatcagcgccgaagaagccctggtgcatgtctcgctcttgctcaaatgcgccgaagaagtcagcgatgaaatcaccgaacgcggcagtggcctggagcgtgggctgatctggtcgatggtccattccgtggaaatggccagggcggtggtggatgcgttgctggatgggcgtggcgcccgttgaaccgatactgttttttgaagcgcgcatcgtgagcgggctcgcccccacggaggcctgatagtcgtttcacaatcaggtatccgtgggggcgagcgctcaggtcagcgtcaggcgctgacggtgttcaacgttaggtctgttcttccagcgcattcagtttcgccagaaatgaagcaggccccattctttgcagcgggaatttgccgcgactcaccgcatcgaaatagcgcagcgacccccacagttcaaaatcccccaccagatagacccgacgtttggcccgggtgagggcaacgttcagcaggttaggcttggaggcggcccactgcgccgctcccgcatgctcggtgtctgcccccagcagcatgaacacggtgtcttgttctttaccctggaaggtatgcacggtgccgacggaggctttcaaccactgcttcaactcgcccgcaggtaatttcgggcgatggttgggccgggcccaggccgccatgcgtatggctttttgcagggccaggcgcacggccttgaacggcgagatcacgtacagctgcggcagctccccatcgcgcaggtacagctgccccagcagatcgaccatgaactcgatctgctgggggacaacctgtttgtgttcgacattgccagggatatcgacccagcaactggagctgtacaccggggcgtcctgttcggcgtgggcattgggcaggccaaagaccatcttgttaccgtaggcgatctggttcgacaggctgaacatgggttcgatgcagcgtctgtggacccgcaacgggctgccgatccacagctcttcgtcggtatcgttcttgaacacgctgccatagagattgttgtgatccgccaggctttgcactgacacacgattgggggcgaaggcatcgttcgccgtgtgtaccgatagctggcccagggtcttgaccaggcgttgcggcagggtgaagaccggctcgatttgcagggggtcgcccaccaccatggctctttgcgcccgccacaaggcaccgacggcggcctggggcacggcttgtcccgcctcgtcgatgtacagccagcccaaagagccagcacccaacccacggaactggttggcaaaggaggcaaaggtgctcgagaccaccggaatcaccatgaacaggctttgccagagcacctgggtcagtcgctcatcctcgggggtcttgttgctcagcaacaggctgatggcggcgaggttggcgctgaagcctttgccgttcgagcctgagggcgccacctcggccagccaggcttcatgcagggtcaacgccgcggcgaacaaggtcgagcgcaagcgattgagtgcttcatcatgccaaagcccattgatctggaactcgctgttctccagctcactgagctggcttggcaaattcggacggcccaggcggctggcgaaatcgtccaggcatcggcacttgtcttgccattgcgccttacgggtatcaagttcgcttttacagaacagcaatgcggtttgcgcgctttcaagttctggtctgaggctattgttcagaaggcttttcgcgcggttgatctcttcatgcgccaggcgctggagccgggcattttccagttgttcgtcacggtgggttttagcggcttgagtgttgaacaagcgcttccaccagaccggacggctgcgatctatcaggcgctccagttcctgcaggctgctcagatgttgcgctgatgcctgaagttgctgttgctgttggtcgagggcttgctgggcggacgccctggtctgttcggcctgattgaatgactgttgctgaaggtgcaggaaggcctgttcattggtagccgccatttcttccagcaggctggcgtaacgggctcgttcctccagtgctttgctgacttcctcatcggcttttttgaaggctgcgctggcatccttgaaggtggggcctttgtattcatccacccattgccgaattgtcagtggccgattgggttcggtggagtctaccggggcgaagaacatgcgttcctgtagcacttttcggttgttgctattgccgagtgcggcgcagatcaagccccagggtttgtcctcgtcggacaggtcgctgatgctgccatcgcttttttgtgcggcaatcttatgggcgaccggttgcaggtactgcacgtcgctccagcattttcccagggatttgcgtttgggcaggtctcgggaaatgttttccacggcggcattgttggaggaggccaccaccatttcatagccggtcaactcaggtttgagcgcgcggatggtgtaggtattcggcatgcccttgaaggtgacctgcggttttttcccgccgacgaaagcatcttccgcctcgctgtatcccgccaatacccgcgcccgacgcacgatgttctcggcgaacatatcgcgcaataacgtcgttttgcctgtcccgggtggtccgttaacggagaacaccccactgttttccaaggtgccgagcgcggtattgatcgcgaactgttgcatcaggctcatggcatggccgggctcatccggccaatgcccggggtttatgcattgcggttgcagggcctggtaaatggccttgcggccattgtcggtatacaggtcgattcttttgcccgggtcggcttcgcccaggtattgaagcaaaggcagtggctgttctgcgcgttgcaggctggcgatcgcacgctcgatgtcttttatgaaaaagctgttgaggatgtcgatctcggtatcgggttcttcttcgtcctcgacttccgtggcctgtgccgcagagggttgggtgagtggtttctcgaccttgggctgggtcagcacttgaagcaatgcgacagcgctaccgctgttctgctcaggcgtgaaactggcccagttgcacagcagttgatgcaggtgcatgacttcctcggccatcaaggccgggtcatcgttttgctgacgctgtccgtggaagttgtgcagcagtttgaccaactgctccttggcgtcctcgaaggcttgatggccaagcgcaccaagccctttgctcaccgtttgccccagggcccagggagccgtcgacagtgacacggcatccagttgcgggacggcttgcgcattgagcttgatcttggcgaagcacgtcagcccttcaagctccacccgttcctgctcttcgtagaaggtgttctcgtctaccgataaagcggccagatacggttcgcaaagagtcgcaatgacggaggcgtcaaagaccccgatatagagattgaagcctttgacttgaaggtcgtcaggtatggaaaagttgcgccagcggctgtccttgctctgctggagatctttctgggagagccatcgggtctcccattccttgaagtcctcaacatatttcccgagggcataaggtagaaagaattccaccttgtgccagtaatcgagaatgtctaaaagcctggcttgtccttgagctttcaaaacgtcacatccctgtctgcgtgaataaaggcagtagtgtaacgctgtcggtaaggctaaaggccattagcggtcaggtcgtggcgtctctcattcatttgggcccgaaaatcttgcccagcttgtccggtgacggtgcgccttgttgctgttgcagctcgcccttgtcgtccatgtagaagatcgccggggtggcggacagctccagttcgtccatcagcgccatgttggcgtcgagcttggcctggacctcggcggggatcttggccagaggcttgaggctgctgcccttgccggctttctcgtggtcctgcagggctttctgcgggtctttggcggccagcagggcggcggatttgcccgggctgtcttcgcggatgatgccgaccatgatgtgccgcagctggaccttgccggcgttcacccagggccgcgcctgttcccagaacatgttgcagtaggggcagttggggtcgctgaacagatagatcacgcgcggcgcgtcggccttgccatcggcgatccagtggctcttttccatcttggcccagacggccttggccattggcgcgtacaccagtttctgcagcggctcggcgctcaggtccttgccgtcggcgtcgtacaggttgcccagcagcacatgcttgccgtccggggtcaggtacagcgccatgccgcggttctggtactgcgcggcatagcccttgaggccgtccggggcatcgaagctaccgacgatcttggcgcctttggcttcgatcttcttgatcgcctcgggcagttcttcggcgtgcagcagcggggcctggagcagggcggcgcccagggacaggctcagcaggtggcggatgaaaggcatggcaatttccttgaaggggcggcctgcgtggccgtggtcgaatgcgctgagtcgaaatgttccagggcgcgggccaggctggcttcggacagctcgcccaggtggctgccgagcaggcgcccgtcggcgctgtagaacagcgtagtcggcagcgccatggagcccacggccttgcccaggcggccgctgccgtcgaacagcacgttgttcaggttcagttcctgggtggccaggaaggtactgacgctctgcatgctttcggcctggttgacgaacaggaaggtcaggtccgggcgctgctgctgggctctttccagcaccggcatttcccggcggcagggcgggcaccaggtggcccagagattgatcaccagcggtttgccttggtagctggtcagttgcacggtgccgccgtcggggttgcgcagggcgatttccggcagccgcgtgccttgttcgaaaaggctcagggacaggctggcgagcagccagaacgccaggccgctgccgaccccggcgcccagcggctggcgcagggccgggcggcgccagccccaggcgagggcggccagcagcaggacgatggcccccggccaggcgaggaaaccgccgtcgcgcaggtcgatgatctgccacaggtcgtggcgataatgcttccagtaggcgaccacgaagccgatgcgcgccgccagcatgcccagcaggaacaggccgaacagcaccgattccgggttctcgccaccgcgcttggcgactcgccagccgaccaaggtggccagcgccagggcactgatcagcagcaggtggttgagcgcgatggcaaaggtgccgatggtaaaggtcagcatcaacgggcttctcgggtagcggtccagcgttgcaggaaggcagccgcgtctacctcaccggtaatccgctggctgcggcgttcttcgccgtccgggccgatccatagcaggctcggcggccccggcactttataccggttgagcagttcgcggctggcggtgttgtcggccgtcacgtccaggcgcagcaggcgcacgtctttcagggccgcgaggacctggggttggccgaacacctgtttttccatgatcttgcaggacacgcaccagtcagcgtagtagtccagcagcacccactggccctgggccctggcggtgtcgagggcgtcttgcagggcggtcgggtcgttgacggtgctgaaggcgtcgtgggcgctgatggtcgccacgccattgccgccgctgtagaccttcagcggtcgccacaggtcgtcgctgccaccggcggcgcccaccagcagcaggctgccccacaggccgaataccactgaaccggcgccgaacacatgcccggcgcgcccggccgcgcgcatctgctgccaggcggtgtaggccaggaccagcgccagcgcgccccacaggccgatccacagcgattcgtcgagtaccgggcgcagcagcacgatggcggtgccgagaaagaggaagccgaacacacccttgagcaggttcatccacgggccgggcttgggcaggaagcggttgcccacggtcaccagcaacaacagcggcaggccgatgcccaggcccatgacgaacaggatcagcccgccgtgcagggcattgccgctctgggcgatgtacagcagggcgccggccagcggcgcggtcatgcacgggccgaccagcaggccggacagggcgccgagcaccccggcgccgaccaggctgccaccgctgcgcgagcggctggcgttttccaggcgatcgcgcagggccgccggcaattgcatctcgaagaagccgaacatcggcagtgccaggaccacgaacactgcggcaaagctgcccagcagccagggttgttgcaacagggcttgcaggttggcaccgagcagcgcggcgagcacgcccatcgcggcatagaccaacgccatgcacaccacatagctgccggccagggcgaagccgcgccgcgggctggcgccgctgcccaccaccaggccggcgaggatcggcagcatcggcagcgagcagggggcgaaggccagcagcaggccgaggccgaaaaacaccagcaggctccagcccagggcccgctgttgcaggccgctggccagggcctggtcgctggcctcggtggtattggttgcattggtggcggccgggctgccgcccaggtccacttccagggattgcggcgggtagcacaggccggcgtcggcgcagccttgccagccgaccttgaccttgccggtggcgccggcggggattttcagttccaggccctggcgatacacctgctgcgcgccgaagaattcgtcgctgtgggcctcgccctcgggcagggccggtttgtgtgcgtccgccaggccgtcgaatttcagccgctgctgatacaggtaataaccgtcggcgatctgccagaacagctgggtttcccccgacgccaggcgttcggaggtgaagacgaaggctttgccgaccgggagaaagtcgggtttgacctcgaacgggttgttacccgcctgggccaggcccgacagcagcatgaacaacaggatgaacagacgacgcatggaaaagccttaaaccggtgcaagtggggggcacaatggccgatggcgattaaccgatgattaaccctgcacgccttgtggcactggcggtgcgggcataatgtcggcttaatcggcgctggttttaatgcaccccttttctacaggttccaccatgcacgtacttgtctgtgaagatgatgagctgattgccagcgggatcgtggccggcctcacggcccagggcctgacggtcgagcacgtggccactgcctcggcggcgcgggccatgctcggcgtggcggaattcgacgtgatggtgctcgacctcggcctgcccgacgaagacggcctgaagctgctcaagcagctgcgccacaacggcctggaaatccccgtgctgatcctcaccgcgcgggactcggtcaccgaccgggtcgacggcctgcaggccggcgccgacgattacctgctcaagcccttcgacctgagggaactggcggcgcgcctgcataccctgttgcgccgggtggcggggcgcagcgtcaacctgatcgagcacggccgcctgacctacgacccgagcacccgcgaaacccagctcggcggccagccggtggacctgtcgcgacgcgagcaggcgctgctccaggcgctgctgcacaaccgcggccgggtgctgtccagcgagcagctcaaggacagcgtctacggtttcaacgacgaactggaaagcaatgccctcaacgtgcacatccatcacctgcggcgcaaactcggcaacggtatcgtcgagactgtgcgcggcctgggctatcgcctggggccggcggatggcggggaggagtcgtaagtgatgagcctgcgtttgcgcctgagcctgaccatcggcgcggcctttgtgctgatctgggcgctggccgcggcctggatgttcagcgacttgcgcaaccagatgatgttttccctcgaccagcgcctggtggcgtcggcgcgcatggtcgccggcctgctggagcaattgccggccttgccgagcaagggtgagggcacccatttcagcgccgaacagttgaacattcccgggggcatggcctgccaggtcagctccctgcgcggcgagatcctcgcccgcagccataaccatcccgacgaaaagctcgaagccgaacgcatgggttttcacgaccagatgatcgacggcgtgcgctggcgcagtttcaccctggcccggggcgacctgcgcatcaccaccgccgatcgccaggtcgagcgtgaagcgctgaacatgtcggtgctgctggcggcctcggtgccggtcggcgtggccttgctcggttgcctgtggttgttgtggctggggatcggccagggcctggcgccgctgaaccgcatgcgcgatgccctgatgcgccgcagcgccgactccctggagccgttgcagatccagccgctgcccagcgagctgcggccattgctggaaacccagaaccagctgttccagcgcatcggcaagaccctcgagcgcgagcgccgcctgaccggtgacgccgcccacgaattgcgcagcccgctgacggcgatcaagacccacctgcaagtggcgcggatgaccgacggcgcggcccgcgatcaatccctggcgcgcgccgaagaaggcgccgaccgcctgcaccggaccctggagcagctgctgttgctggcgcgggtcgaaggcagcctgtcgttcgaggacggcgtgcagtgcagtgccgaacaggtggcgaaaaccgcgatccaggacgccgccagcggtgcccggcagcgggtcaggctgcacatcgacgagcgggtgtcgacggcgccgctggaaatgccctcggtgctggccatcgccgcgttgcgcaacctgctggacaatgccctgcgccacaccccgagcgatgcgccggtggagctgaacctggaaaccatcggcaatcgcgtgcgtttccaggtgcgcgaccacggtgacgggattcccgaggatgacttgcagcacctgacccagcgcttctggcgcaatggccagagcaccggttgcggcctgggcctggccatcgtccaggcgattgtccagcgctgcggttgcgtgctgcatttcgacagccggcccgatggcttgcgggttgagttgaccatgccgttgcagtctgcctgagggcctatcgcgagcaagctcgctcctacagtgggcagcacaacccttgtaggagcgagcttgctcgtgaaaaaactcgaatcgccacagtcccctgacgattcgtccgcttcccgttatctccccacgcaataaaccctcgcctgggtgtaaatcctctcgtcgctgatgcgtttccagaacaggaaaacctgcgagtgcgcgctgaaccggctgcgtacctgtgtggtgtgcggtttcgctcaactcatcagcgtgaggattcgagagatgtcagttgctaccagccttgtcgacgatcagcccgcgcggaccagtcccgcgcctgccgagacgctttaccagttcaccgaatcgccgttgctggcccggcagaaccagcaggaatccaatgcccgcagttacccgcggcggatcccgctggcgctcaagcgggcgagcgggattcatgtcgaggacgtcgaaggccggcgtttcatcgactgcctggccggtgccgggaccctggccctgggccacaaccacccggtggtgatcgaggccatccagcaggtgctggccgatgagctgccgctgctgaccctggacctgaccaccccggtcaaggaccagttcgtccaggacctgttcggcctgttgccgccggccctggccgccgaagcgaaaatccagttctgcggccccaccggcaccgacgccgtggaggcggcgctgaagctgacccgcaccgccaccggccgcagcaccgtgctgtcgttccagggcgcctaccacggcatgacccagggcgccttgagcctgatgggcagcctggggccgaagcgcccgctgggtgcgctgctgaccactggcgtgcagatcctgccgttcccttacgactaccgctgcccgttcggcctgggtggcgaagccggggtcaaggccaacctgagctacctggaaaacctgctgagcgatccggaagccggcgtacagctgccggcggcgatcatcgtcgaagcggtgcagggcgagggtggggtgattcccgccgacctcgactggctgcgcggcgtgcgccgcatcaccgaaaaagccggggtggccttgatcgttgacgagatccagagcggtttcgctcgtaccggcaagatgttcgccttcgagcacgccgggatcattccggatgtggtggtgctgtccaaggccatcggcggcagcctgccgatggcggtggtggtctaccgcgactggctcgacacctggctgccgggcgcccatgccggcaccttccgtggcaatcagatggccatggccaccggttccgcggtgatgcgctacctcaaggaacaccgggtggccgagcatgccgccgccatgggcgagcgtttgagcgagcacctgcggatcctgcagcgcgactatccgcagatgggcgacattcgcgggcgcggcctgatgctggggatcgagctggtggacccggccggcgagaaagacgccctgggccatccgccgcagttcagccgcctggcgccgctggtgcagcgtgaatgcctcaagcgcgggttgatcctggaaatgggcgggcgccatggcagcgtggtgcgtttcctgccgccgctggtgatcaccgcggcgcaaatcgaccaggtggcggatattttcagccgggcgttggcggcggcggtcgccaacctctaattttccacgggccttgaacgttccttattcacaaccgctgcgccttcagcgcggcgagccttatagcgatggagacacgtaatgacttcagtattcgaccgcgaggacatcctcttccaggtagtggtcaaccatgaggagcagtattcgatctggccggactacaaggctgtgccacagggctggcgcaccgtgggcaagagcggcttcaagaaggagtgcctggcctacatcgaagaggtgtggaccgacatgcgcccgctgagcctgcggcagaagatggacgcccaggcggctgccaactgattaccgcgtactgacgttgacctgtagccgctgccgcaggctgcgataagcccgccagggcttcggcgctcttaagatcgctgacgaccgttccggtcgatcgcagccttcggcagcggctacagggtgcaaaagcccgttgaacccctcaggtccagcgggcttttttatgggcgtcagcccaggcgcttgatggcctgcaaggtgtagctcaatggcaggcgccaaggggcgtgttgcaggtgccattcgccttgttcgtcacaacgcatctgcccgggcagggcttcccaggggatgctctggtgttccaccaggccgctgatgtccaggccgtgcttgagcagcgcgctgacgatttctcccaggccgtggttccacgcatgggtcaccgtggccttgagcgggcggtcggtactgacgtaggtgctgtcgtcgtcccacaccagcggttcgctgcgctcgaagtagggcaggtcgaccaccagcgcatcctcgtggctttcgtccagggcccagagcatcgggtggccttcgcggataaacagccggccgccgggcttgagcaattggctgacattatgcgcccaggtgtcgacgctgggcagccagcacagcgcgccgataccggtgtagaccagatcgaacgcgcctttgggcagcacctcgcaggcctggtagacgtcggactcgacgaactcgatggcgctcccggtgcgcgccgccaggctgcgggcttcggccagggacgcgggggagaagtccagcccggtcatccgcgcgccaaggcgcgccagggacagggtgtcggtgccgatatggcattgcagatgcacgccgcgcaagccgctgatatcccctagcagcggcaggtcgaaacgcaccacctcggacaggtgccgcgggtcgtcgacaaacatctgtgcctggtagtccggcgaggccgcgtgcagcggcgcgcgctcgtcccagttggcctggttgagcttgaggtagtcactcatggctgggcttcctgtccgttcttgggagcagcaggctagcactggcaaggcgggcgattcttgggggaatttgtaagcgcaggcaggcgccagtggctacacggatcgcagtgtttgtgtagccgctgccgagcttgcgaggctgcgatcggcaacgcagttgccgcaacacttgagccccggatctacctggaaaaacgcgttggctggtttacgacggctgcgtctgaatgccgcccacgcagatcgcagcctgcggcagcggctacaggaatctcggtcgcgcccctgtcacccattcaggacttggcgttcagcgccgtggtcacctgcttgatgtcgttctccagctccgccagcgggtcggcgctgtcggtttgcagcaccagcaactggctgccggcggcgtcgatggcggccttgacggcagcggacggctggcggtggtgcaggacgatggccacgtcgttgtccttgagccgggtttgcagttgctgcagggcttcggccgtccactcgttgtcggcgcgggcgtcgacctccagcagctccaggttgagcccgctgaccaggtaaccgaagtggtcgctgaggctgagcacgctgaggttgtcggcattggctagttgcccctcgctatcggcgctgagcttgagcaggcgctgcttaaggctggccaggttggcgtcgatctgcggcttggcggccggcgccaggcgcaccaggtcggcggccagcacatcggccatgcgccccaggttattgctcgacagccacggctggctgttcaggccgtcgctcttgccgggctgcagggcgacgccgggcagggcaccgtccaccgggcgcgcggcatcgacttcgacgatgcggatattgctgcgccgcgcattggggtacagcgggtcgtccggccagatcgagcgcaggccgatcaccgcgtcggcgtcgagggccagcttgtgcagcgccggggcgccgcggccggtgaagtaggcggtctggcgcgagcccggcaggttgtcgggggcggcgcgctcgagccgcacatcggtgccttgcagcagccactggccgaggccgaaggtaatcggtagcgaggccagcacggtgagcggcttgggtgagctggcgctgtgcagcgccgtggtgcccaggctctggttggcggtgacgcgcatcggttcgaaacggtccggctgggccagggccggcgcgctgcccagcccagcgagggccagggccaaagtcagggggcgtgtcaggtgacgtaatgaactgtgcatttatccgatattccctttgaggctggggacaatgccgcgggcaatggcggccagggcgaaggcgacaccggccaccaggatgatcgcggcgccggaggggacgggcaggtcgaagaggatcggcagcaggatgccgcacagggtgctgaccgtggcgatcagcaccgagatccagaaaaagcccttgagcgactggctcaacaggcgcgcggccgccgccgggatcaccagcagggcgcccaccaggatcgcgcctatgactttcaccgcggccacggtgatcagggtcaccaggatcacgaacaggtagtccagggttttcaccgcgacgccgcgcaccgccgccagttgcgggttgaagctggccagcatgatgcggttgtacagcggcaggctcaggcccatcaccagggcgccgacgatcagcagcaccagcaggtcgttgccgttgaccgtgagcaccgaaccgaacagcacgttttccaggatgtgcacgttgatcttgccggcgaggatcagcagcaggctggcgcccagggccagggacaccgacaggaacaccccgatcagggtgtccggcgccaggccggtgcggttgcgcaggtagttgagcaggatgccgaacagcaggcagtagccgaacaggctgccgtacgggccggtgtagggttcgccgagcaggatgccgatggccacgccggtcagcgccgcatggcccaccgcttcggagaagaacgcaaagcgcttgaccactaccaaagtgcccaggccgcccagcaccgggccgatcagcaagccggcgagcagggcgttgaccacaaacccataggccagggcttctggcaggtaaccggaggaggcccagccctggatcatcagacgaaaggcttcgtaactcatcaggcaacactcccgctgacgatatccgcgctgcgcgggtgggtggaaaacagcgtcagcaggcgttccggggtcagcgcctgttgcgggtgggcgtcgaacagcacgcggcgatgcaggccggtgacccggtccgccaggcggccgaccgcttccaggtcgtgctcgatccacagcagggtgatcccggccaggcgccagtcgccgagcaggcgctcgaagacctggattccggcttcgtcgagggccgacatcggttcgtccagcaccagcaactgcggtgccgggatcagcccctgggccagcagcacccgctggcgttcgccgccggacagggcgcccatgcgccgcttgcgtttgtcctgcatgccgacccgttccagggcttcgcctatggccgcggcgtaatgccggctgaggccgaggaaagccgggcggcgctggcacatggcggccatgaagtcgtcgacggtcatcggcaggccgcggtcgaattccagggcctgcggcacatagccgattactcccggctcgcccggccagtgcaggcgcaactggccctggtggggcatttgcccgagcagggtcttgatcagcgaactcttgccgccgccgttggggccgaccagcgcatgcacggtgccgggctgcaccttgaagctgacgttgtcgaggatggtggtgcggcccagggtcaggctgacctgatcgaattcgatggacgggccgcgggccaggctgtgcagggcggtcatgcgccggcctcctggatcgcccggaccacggtgtcgaggttgccggccatttccttctcgtatttttcggcgctgtagtcgccgtaggaaatgtgcgacagcgggtagagcttgaccccggactcgcgctggatggtgtcgacgtaggtggacgggaagtccatctcggagaagatcaccttgacgtccagttcacgcagttggtcgatggtctttttcaactggctcgggctgggctcgatgccatgggccggctcgaccacggcggtgacttccaggccgaactcgcgcagcaggtagtcataggccgcatgcaccgtggccacccgcaggtcggcgttgggcgccttggtcagcttggccagggcgtcggcgcgcatctgccgcaggcgtttgccgtaggcgcgggcgttctgggtataggtcttggcgttggccgggtccatcttgcccagctcgcgggcgatgttgttgacctgggcgatggaggcgctgatggacaggaaggtgtgcgggttgaccactttgccggcgccgcgtgcggcgatgccggtggcggccagcagcggcacgttctggttggcctcgatcaccgggatgtccgggcgttcgctggcctcgatcatgcggtcggcgaagtcatcgtggccgacaccgttgagcacgatcacgtccagggtaccgatgcgcttgatgtcttcggcgcgcggttcataggcgtgggggttgaagccggcgggaatcagcggcacgacctcggccttgtcgccgacgatgttggccacgtagctgtagtaggggtgcagggtgatgccgatacgcaggcgcttggcctggtcggccgtggcgagagggctgagcaacagggcgaacaggctgaccagcagcacccgcaggagcgggcggcgttgcgatgaaataggcatgggctagcggtcttctctcggtgaatgcgtgggttcagtggcgatgctggcgggtcactccggcatcgaattgcgcgaccacctgctgccagccggcactggtcagggcggcgtcgctgaggtcgtcgggggcggcgagggacgggccgcggttgagccagatgtccggggcggcggccgggtcggcggcgatgcgcatcaggaaggagccggccactgcattgttctggctgaggccgacataggcctgttgccgcagttgccaggcatgcccgccacggctcaccgaactggcgtcctgggcaaagggcgcgaaaccttcctcggccagttgtttgggtgtcggcagggcctgggcttcttcgcgcagcaggcggatttcgtcgagggtcacccgcaggtcggcgtacaggccttgttcgccggcggtaaggtcgcggcgggcgtccagttgatggctgtcgacgctcgccacttcgctgctttcgccgcgccagagcaccacggtgccggccacgctgaggatcaacaggcacagcagcaggacgtagagggtttcatggccggcaccggccgggcgcacgacttggggggtggaggtgctcatggggcctcgatgtcggcttggtcgatctcgaccacatggccggggccggcgtcgaacagcacgtagaactcggcgtcgggtttcttgaaggtcagggtggagtcggcgcccagcttgccgggcaccaggatggtttcgtcgtagccgatcacgtccagggtcacccccggggcgccgctgccgtcggagaagccgccggtgcagcggatctgctcgccgtcgatctgcttgcactcgcacatcgggttgtgggccagggcgccgccactgaatacggcgctggccagcaggagtgcgccggcaccgagcaggcgcaggcgggcggtgggtacagcaatcatggtttgcctccttgttggttcagccaggcgagggtcgccggggatgcctggcccagggggatggccgcctggtgcaggctgccgtcccagccttccatggtgatccacagctcggcgtcggccttggtcttttccggaacgggcaggctggcccccatgcggtacggggtgccgaagaagatcaccccggcggcgcgcaggctgcggggtttgccgatgcgcaggtaggtggccttgacctggtcgatgcaggcgtcgcacagggcggcattgaagcccttcatgtagccggccggcccctggagttgcggcgcttggttacgcagttcggccaggcgcaggctccagggcccgacctgtacctcgcccacctcgcgttcgcccaggccgctgtcgccacgggccagcgccgcgtcggcgaagtacttgggcatgaagccgagggggatcagcaacagcaggatgttcaggtggaagcgccatttgagccagaactggcgcaggggcgaaaccggcattgggttgtctgtcttgctcacaggttgccctccggcgtgtcgctgtgcagggccgcaaccgggcgctgggcgagggcggggcgcgctgttttggtgctgcgcttgagggccgcggcggtggccagggcggtgcgcttggtccagatcagcaggccgctgagcaccatcatgctcagcagcaggccgaagaagcaccagatcagcttgatccagatgccgccgaaatcaccggtgtgcagcggacgcatggactcggtgacgaactccagggccgagcgatgggacagcaggtgtgtggtatccaccgagccgctgtaagggttgaggttggcggtctggtacatcagcgggtaccagccgcggccgccaatgaacaggtggctgtaggcattgctcggcagcatgacgaagctgacctcgaagcccggtatctgctgggtggcgatgcggatggcttcatcgacgccgatcatcggcgccgggctgccgtcggcggaggtcggcacgctttcgcgggcgatcaccggaactatgggttcgctggaaagggtgatctggttgtcgccaaggatcgcctcgatcaggaaccaggtgccggtgatggagatcaccgcgatgaaccagatcgaccagatgccgctcaggcgatggaagtcgccccagaaaatccgcgcgccgtggcgcaggcgcagggtcggcttgaggaagcccttccagaacttcttgtagaccaccaggccggtgaccagcgaggccagcatcggcaggccgagcagcgataccaggtaccagccccagctgtagccgttggtgaaaggcaccagccaccagccgtgcagggcgcgggtgaaggcctggaagttgaattgcgggctgacgccctggatgacgccggtgtacgggttgacatagacctcgacggaacggccatcggggtagctgacgcccacggtcagggcgaaatgcgcttcgtcgggggtgctgatgctttcgaccagggtctgcggttcggcctgcttgatggctttgacgatctggtcgtagctcagcggttgggcgtcgcctgtgggtttgctggcgcggatgtcggggttggccagccagacgatttcctggctgaccacggccagggtgccggtgacgcaaacgatcagcacaaagaaccagatgggcagggccagccagctgtgaacgagaaaccagattttcgagcgggacttcttcgacattgagcacgcgtcttgattcgaggagtggagccgcgggcggctggtaagcccggagagaaacccgcggcgtaaccttcgccaacgcgacctgctgcatctaattaagacgaatgagaatcgtaaatcccgaaagacgatatgaaagtaaatgtttccgcgcgaccaatggcaggggcaaggtcctgggggaggctatcgcgggcaagcctcgcgacagaagaagcgcgagaggcttgcctgcgattaacggttttcaggtacagggcttatccctgttgtttaaacatctccacggcccgctgcttgatctgctcttcgctcaggtcttccttgcgggtggcgagaaaccacaggtggccgaacgggtctttgagggtgccgctgcggtcgccgtagaactggtccttgacctcggacaccacctggccaccagcggcgatggcctgggcgaactgtttgtcgacatcgttgacgtacaggtgcaggccgacggagggtgattggtcgggattgctcagtggcccttgatcgcagggcgttcccagcatgatcgggcagtcgccgatgcgtagctcggcatggccgacgctgccgtcgggcatgtccaggcgcatgacctgggtggcgccgaaggcatttttgtagaactcgatagcctcggcggcctgcgtaatccccaggtagggcgtgatgctggggtaaccctcggggatgggtttgacgctcatctcggttctcctttcttgtcatgggtttgtcgaagtgaacctggccggttttccggttggttcactataggcccgggcagtccacagtctggtttgaactgacgaggtgttcgcctggcaacagtgagcctgcgatcaggagaagaggtgcagccgctgccgcaggctgcggtcgggctggggaaaccgctgtgccgcctctcagtcggtttccagcaattgcgcgcccgggccatgctcgcccagctggtcgccctggttgcgcagcgggcagtcttgcatcgacaggcagccgcagccgatgcagccgttgaggcggtcgcgcagcagggtcagttgcttgatccgctcatccagctcctggctccactgctcggacagccgcctccagtcggcggccgtcggcgcgcggtggtccggcaggctgcgcagggcctggccgatctcggccaggggaatgcccaggcgctgcgccaccttgatcagcgccacccggcgcagcacttcccgcgggtaacggcgctggttgccggcgttgcggttgctcttgatcagccccttggtttcatagaaatgcagggcggtgaccgctacgccactgcgggcggccacttggccgacggtgagttccttgtgcacggtttcggggctgagcatgcagcgctcctgcgggtggggaatgagcaaaagtcgcttgacctttacttaactggaggttttaccctgcgggccttcgaatcacaagattccgtttatccgtcagtggggactcgccatgcacgcgtttgcgcaaaaccgcagctttacgcaattgatcgaattcgaaatcgaaccccatcaacaacccggcctggtgtcggcgctgtccgagcagaccgagcgcctggcccagggctacccgggtttcctgagtggcagcgtgcaggccagcgaggacggccggcgggtgctcaactacctgcaatggcaaacccgggaagccggcgaggcggccttccagagtttcgagaagggcgaacaggacttctggcaactgctgcgtgcttatcaggccaagaccgtgacctttggctcgttccaggtggtgcgcagcatcgagcgcagcccggacaacgcgctgcattgccgcctggccagctagatcgacagttgcagggtgcgctcgtgctggccgggtttttccggcggacggcgcttgttcaccgccagttcgccgatcttgatcagccgggtgcgggtgacattgcggctcaggcccagcaggttggcggtgtgcacctggttgtaatggctgaagcggtaggccgcgcgcagcagcgcgtcctcgaccttttcatgcagggcgccggcctgctcttcgaagagtttgtgaaaggcccgctccagcagggcttcggctgagtcgtcgtggctgtcgtcctggcgctcgatgcgcatgttcgacaggcgcaggtcgtcgcgctcgatcacgccgtcgcggcagatcagcagggtgtggtggatgacgttttccagttcgcggatattgcccggccagctgtagctgcgcagcttgtgctcggcctcgctgctgatagtcacggcgccgtagcccaggcgctggctgtaggcttcgataaagtgccgggtcagcggcaggatgtcgccggggcgctcgcgcagtgggctcagttccaggctgaccacatcgaggcggtagtacaggtcctcgcgaaagtgtccggcgttgatggctttctccagttgcacgttggtcgccgccagtacccgcacatcgataggaatgcttttgcgcgaacccaggcgcaccacttcgcgctcctgcagtactcgcagcaacttcacctggatcgccatcggcaggtcaccgatctcgtcgaggaacagggtcccgccattggcctcttcgaaccagccggccttggcgctcagggcgccggtgaaggcgcctttttcatggccgaacagctcggcctccaccagcgactcggagaacgcgccgcagttcaccgccacgaagggccggttgcgccgggcgctgaggttgtggatatggcgcgccaccagctccttgccggtaccggtttcgccgatgatcaacacgctggcctcgctcggcgcgacctgctgcagatgcgccagcaaggcctgggatttcgggtcttcgaacacctgggcggtggcccggatcgaggtcgccagggccggcgagggcggtagggtcaaaagctgcatggacacgctccgggagcagaaggctaggaatagaaagtcggggtcggcagggactggttcagggcccagtcacccaactcatggagtttgtaatccaccgggtcgtgcagggtttgcgtgcgcaggttgcgccaatgccggtccaggcgcagggaggcgtgggtggagcgggcgccggtgacctcgaacaggcggctgcacagctccagaccctggcgcgtggtggcgaccttggcggtggcgatggccgtggccaggtggccgcgttcttcggcgctcaggttcggccccttggcccaggccttgtccagcagctccgcggcgcgctccaccaacagccgcatgccttccagggccacccagaaatcaccgtagtgacccagcacataagggtcctgataggcctcctgcgcgctggacttatgccagggccgggtttcggtgagggtgtattggcgagcttcttcaaaagccccttcggcgatgccgagaaacatgtgggtgaaggtcagttgggcgatcagtgggcgcaggcaggcgaagggcgtgctcaagggccccgggtccagcagcagttccgattcctcgacccgcacccgctcgaagctggcgctgccgctgtcggtctggcgctggcccatgttgttccagtcgttatgcagggtgatgccgctgcggccgctgggaatggcggcaatcagcagcttgccgccgttgctttcgtcgaccgccgaggcgatgagcatttccgaatcgctggcgccggagcagaagctcttcttgccggagaactcgcgccagccgccgaggttcttcaccagggtacgggtgtccagcgggttgagggcgttgccccagaaccagttcttgcgcgcggtctgttcgaaccagggttgccattgttccgggcgggcgaacaggcgcacggtggccagcatcaggtgatggaagccgaagacgtgggcgatggagctgtcgaccttggcgaactcgcggacgatgttcagggtctcgctccagctggcgccgaggccgccgtactgggtgggaatgctcagggccagcaggccgctctggcgcagggcgtcgcgctgggctttcggggtaccgccgcgttcgtcgcgttcgacagcggtcagggtaaactcggccgccagctggcgggcggtctgcaagggggacaacaaggcgctttgcggcttggcagtcacgcggtgttcctcgtttggggccggttgcgcggccgtgaaatcggtggggctgtgaggcgagcgcggggcgctcgatcgcgagcaagctcgctcctacagggtgcaggtggtttctgtaggcgcgaggctggcccgcgatagcgttctgtcaggcgataaacaccctcaagctccagccgctttttggctcggcagcacatcattggcgatcatttcgccgaacggcccggtgaggttggtcacgccacgtccggccaggctggcgtagggttccggcagcagcgggaacaccagctcggcaaagcggtaggcttcttccaggtgcgggtagccggagaaaatgaagctctcgatccccaggtccgcgtattccttgatccgcgccgccacctgctcggggttgcccaccagcgcggtgccggcgccgccacgcaccaggccgacgccggcccagaggttgggggaaatttccaggttgtcgcgccgcccgtcgtgcaaggcggccatgcgccgctggccctcggagtcgaagcgcgagaaggattgctgcgcggcggcgatggtgtcgtcgctgatgtgttcgatcagcttgtccgcggccttccaggcctcttccgcggtttcgcgcacgatcacatgcaggcggataccgaacttcaccgtgcggccgtggcgggcggcccgttcgcgtacgtcggcgagtttcgcggcgaccgcggccggtggttcgccccaggtcaggtagacgtccacctgttcggcggcgaggtcatgggcagcgtccgaggacccgccgaaatacagcggcgggtaaggtttctgcaccggcggatagagggctttggcgttctgcacatgcaggtgcttgccttcgaagtccacggcttcgccttgcagcacccggcgccagatcctcaggaattcgtcggtgacttcatagcgctcgctgtggctgaggaagctgccgtcgccgcggttctcgtcggggtcgccgccggtcaccacgttgatcagcaggcgcccgttggacagccggtcgagggtcgcggccatacgcgccgagacggtcggcgagatgatccccgggcggatcgccaccaggtagcgcaggcgttcggtcaggggcaccagcgccgaggcgatcacccaggagtcttcgcacgaacgcccggtggggatcaggacgccgtgatagcccaggctgtccgcggcctgggccacttgcttgaggtaattgagggtgaccgggcgcgcgccctgggtggtacccaggtaatggccgtcgccgtgagtcggaagaaaccagaaaacatccatgacaggtccttaagcgattttcagcagatttttcggatgcacgccgaacagtggcgcggcgcgttctgccgcaaggcgaatgcgggccttcaagggctcgctggtgatctggtaattggcgaaatcggcctcggtggcatagaccccgatgggcagggtcagggcctggaagaaactgaacagcggccgcagctggtgatccagcaccagggcgtgacgttcgctgccaccggtggcggccagcagcaccggggtgtcgatcagcgcgttgaggtcgatcaggtcgaacaggtgcttgagcaggcccgggtaggaaccgcggtacacgggcgctgcgatgatcagcaggtcagcgctttcgatggcttgcaactgcgcttcgacttccgccgccagctcctggcgggacagggccgcgcccagggggcgggcgatgtcgcccagttcgatgagcgtgctctcgatcggcaattgccccgccagttcggcgagcagcgtctgggtcagcaccagggtacgcgaggggcgccaggttccaccggacagggcaacgacttttaatggacgcgacatgatcagttcctttgttgaacagggctcaacgagcagtgagtagtcccagggcttgagcaagagctgtaccagcgacgcaaagccttgagtggcagggcttgtggcgctgttgcaggagcaggctgttgttgggaagacactgttttgttgattggctgttgcctggcgaacagttgctcaggcaacagcaggcggcgcgatgggtctgttataaggcttactaatattcctaaaaaatactttatttccatatttataggtcttttagaaatatgtgcgcctgcgatgggcggcgatagggggaatcgatagccactatcgagcgtgatgatttctgtcccgggaagggcgacggtagcctgtgtccattgcctcgcagcccagatccaggagcttttgccatgaaccgttcgcttgtcttttccttgcttgtcgccactgcggtgctggccggttgtgccagccagcctggcccggagtcgcgtccctataccgccgaggaaacccgcgaactggcgctggaagcactgaaccggcgcgggctgtcctttgatgaataccagcagaagaaggccgagctgcttgccccgcaacggaccttcggtttcgaccagcagggtgaaatgaacgccgagcacagcgtgaccctgcatggccgggccagctgatttgtcgatctgccacggccttgcccgcgcaggctgacagactgccggtgagcgtcggcaaaaccctgtgatgattttcccgccttgcgccttgttcttcagccccctggccgaaccttgcttaacccggctcccggagcctgttaagctgcccctcgggagcgttcctacgcacttttaaatgaagttgtccttctttaactgcatccgatcgggtattgctgacggtctgccgtttttgcgttgccgaaagggcgcgtatcagcgttcggcaccgagcgaaccttgatcctggaacaggctctgcgggtatttttgcgatgaataaacgtcctctctatttcgactacgccgccaccacgccggtggatgagcgcgtcattcaggtgatggtggaatgtctggggttcaacggtaacttcggcaatccggcgtccagttcccacgccttcggccaacaagcccggcgcagcgtcgagctggcgcgccagcaggtcgcccagctggtaggcgcggcgcccgagcagatcgtctggacctccggcgccaccgaatccaacaacctggcgctcaagggcgtggcccaggcccggggcatctccggcgggcacatcatcaccagccagatcgaacacaaggccattctcgacaccgccagccagttgcaggctgccggcgtggcggtgacttacctggtgccggacagcgacgggctgatcacgcccgaggcggtcagcgaggctctgcgcgacgataccttcctggtgtcgctgatgctggtcaataacgaactgggcacgctcaacgacatcccgggcattggccgcgtggtccgcgatcgcggggcgctgctgcatgtcgacgcggcacagggcgcgggcaaggtggcgatcgacctggcgcagtggccggtggacctgatgtccttttccgcccacaagatttacggccccaagggcatcggcgcgctctacgtcggcccgcgcgcgcagcagcgcttgcaggcgcagatccacggtggcggccatgagggcggcttgcgctccgggacgctcgcgacccatcagattgccgccatgggcgccgcctttgccctggccgccgaacactttgacgaagaagcggcgaccatcgcccgtctgcgcgagcgtctgctcgaacaattggccgacgttccggggctgcgcctgaacggcagcccggcccagcgcattccccacaccttgagcctcaccttcggtgaaggggagttcaacccggcggccctgagtgcctccatcgcgttttccgcgacctcggcctgcaactcggcgagcaatgcgccgtcccatgtgttgctggcgctggggctcgacgcccgggcggcggggcggaccatccgcctgagcctggggcgcttcaccaccgagcaggacatcgatcaggccgtccagctgatcaaggcttcatccgccagtgcaccggcgttctgggcggttgcccaaccctgagggtcgatgccctcggtatccaataacaatgattgacctggtagcaggagacacaatgagtacgcagcccttgaccaatggagtggtcccccagcgcctggcgcgcacccgcgagctgatgaaccgcgagggcattcatgccctgctggtgccgtcggccgacccgcacctgtcggagtacctgcccggttactggcaaggccggcagtggctgtcgggttttcacggttcggtcggcaccctgatcgtgacggcggatttcgccggggtctgggccgatagccgttattgggagcaggcgaccaaggaactcaagggcagcggcatcgagttggtcaaactgttgccgggccagcccggcccgctggactggctggccgaacaaaccccggaagggggcgtggtcgcggtcgatggggcggtgatggcgctggcttcggcgcgtaccctgggcaacaagctgcaggagcgcggtgctcgcctgcgcaccgatatcgatctgctgaacgaagtctggagcgaccgcccgagcctgccggaccagccgatctaccagcatttgccgccccaggccacggtcggccgagtcgagaagctcggcaagctgcgcgaaaccctgaaagagcgaggcgcggactggcatttcatcgccaccctcgacgacatcgcctggctgttcaacctgcgcggcggtgacgtctcgttcaacccggtgttcgtctctttcgccctgatcagccaacagcaggcgacgctgttcgtggcgctgagcaaagtcgatgacgccttgcgtgccgtgctggaacaggacggcatcaccctgcgtgactacagcgaagtggccgcggcgctgagtgcgatttccgacggcgccagcctgctggtggatccggcgcgggttaccgccggtttgctggataaccttgggaacggtgtgaagctgctggaaggcctgaatccgacgaccttggccaagtcccgtaaaagcctggctgatgccgagcatatccgccaggccatggagcaggacggtgcggcgctctgcgaattcttcgcctggctggagtcggcctggggccgtgaacgcattaccgagctgaccatcgacgagcacctgaccgcggcgcgcgcccgtcgccccggttacgtctccctgagcttcaacaccatcgccgcgttcaacgccaatggcgcgatgccgcattaccatgccaccgaagaagagcacgcggtgatcgaaggcgatggcctgctgctgatcgattccggcggccaatacctgggcggcaccacggacatcacccgcatggtcccggtcggtaccccgagcgccgagcagaagcgcgattgcacgcgggtgctcaagggcgtgatcgccttgtcccgggcgcaattcccgcggggcatcctgtcgccgttgctggacgccatcgcccgcgcgccgatctgggccgaaggcgtggattacgggcacggcaccggtcatggcgtggggtatttcctcaatgtccacgaaggcccgcaagtgatcgcctatcaggcggcgccagcaccgcaaaccgcgatgcagccagggatgatcacctcgatcgagccgggtacttatcgtccgggccgttggggcgtgcgcatcgaaaacctggcgatgaaccgtgaggcaggcactaccgaattcggcgagttcctcaagttcgaaaccctgactctatgtccgatcgacagccgctgcctggaaccttcgctgctgacccaggacgagcgtgagtggctcaacgcctaccacgctgaagtgcgtcggcgcctgagtccgctgctgcagggcgcggcgctggaatggctgaatacccgtaccgcaaccctctgaacgtgaatcgcgctgccggctttgggccggcagcgcgaattgcgttgtttgtcttacctaagttttggcttagctcagggcttcgaggacaaagtccaggcgatcctggccaaagaacaactggttatcgacgaacatgctcggcgcgccaaaaacgccgcgttgcaaggcttgttcggtcttgtccttgagggcgttcttgacctcttcatcgttggtcagggccagcacctccagcggatcgaatcctccctcactgagtaccgcggcaacggtggccggatcgttcaggttgcgcttctcgacccagagtgcgcggaacaggcagtcgataaaggcgataaaacgctgtggatgtcgcagttgcatgccggtcaccgcgcgcatcagcagtagggtgttgatcgggaagtgcgggttgaatgccagtggtacctcataacgtttggcataacgcgccaggtcctgaagcatgtagcgtcctttggcggggatgctgatcggcgaggcattgccagtgaccttgaacacgccaccgagcaacatgggttgataaatcagctggctgcctgtctgggcacagatcttcggcaattgggtgtaggccaggtacgaggtcgggctgcccaggtcgaaaaagaactcgacggttttgctcatcggtaatgctcctttttgttgttatgggggaggggttaccagcgttcgttccagggccgcagatccagttcgaaggtccaggcatcccgtggctggctgtgcagatgccaatagttgtcggcgatgtgctcggggttgaggatgccgtcttcatccttgagcgcgtatttttccgggaagctgttgcggataaagtccgtgtcgatggcgccatcgaccaccacatgagcaacgtggatgttcagcggtcccagttcccgggccatgctttgcgccagcgcgcgaatgccatgcttggctccggcaaaggcggcaaagcccgctgcaccgcgcaagcccgcggtggcgccagtgaacaggatggtcccgcgtttgcgagtgaccatgcgcttggccacttcccgcgcattgaggaaacctgagaagcaggccatctcccagatcttgaagtacttgcgcgctgtttcttcaaggatgctgcagggcacgttggcgccgatattgaacaccagggcttcgatcggaccgatctcgcgctcgatctgttcgatcaaggcaatcacttcttcctcttttcgagcgtcgcaggcgaacccatgggcttcgcctcccgattgctggatggcctccaccagtggctgcaacttgtccgcgctgcgtcgggtgacacaggcgacaaaaccttcccgggcaaaacgcttggcaattgcaccgcctgtggcatcaccggctccgacgaccaaaacgactttcttgttctctgtggctgtagtcatggtgggatcgctctattggtaaacggtcgttaactaaacgaacgttatgctacgatccgccgagcgtcaaggcgaagagaggagaggggcgtcatgcgttattcagccagtcacaagcaggaaacccgggagcggctgctgcagagcagcgcggtgtcagcgaaaaaagaaggattttcgactgtgggggtcgatggcctgatgaaggcgatcgggctgagtggtggggcgttctacagccacttttcatccaaggatgagctgttcggttcgatcgttgagcgggaactgagccagagccttgagcgtctggggggcgatggtgagcaaagccggatgcggcttgagcgctgtctcaagcactacttgagcatggcgcatgtcgagagccctgaaacgggctgcgccttgccaaccttgggcgcggaaatctcacgggcggacgaggtggttcgacagcaggcgcaagactggatttgccgtttgcagcagagttgggcgcataccctgggcagcgacagcctggcctggtcgattctgtcgcaatgtgtgggggcgttggtggtggcgcgaatgctggtcagtccggacattcagcgccaggtcctgaagtcgagccatgacgaaattgttcgtcaattgccaacgcaggatgtgcagtaggcaggtgctgcctacttgcagatgacgatcatgctgcggctggtatagccggcgggattcaggccgaagggatagtcgcccggatcctcaactgtatctccggacttggcgatcaccttgtagcctttggggccgcaggaggtagcagcgctggcgtagcatttgtcccaggaggaggacaggccggagcagttgatatgcaggcccttctttccgcgcttgacctcggttttcgaagttgcggcgcaacctgcgatggccagtacggctaacagaatcaaaaaacgtttcattcctgtccctattgctgatcccggatctgttgtccgggttcgactgcgttagctgtcactttggcgtctgtgcggtccttgtctgaaaaatccatgactggcgctgagttacagcgcctaaacatggcctaattgagcggcaaataccagagctatgtacaaccaggaatcaatccgctgcgaccaaaggtttcgattcgctgcgcatggtcagggtcgcacccactgacgccaggatgatgcaggcaatagccagccactgcgcgagcgacaggaactcgtggaggaacagcagcccggacaaggcaccaaaagcaggctcgatactcatcagcgtgccgaaggttctcgccggcattcgggtcagggcgaccatctccaggctgtagggaagggcggtggagagaatggccacgccgatggctatggggatcaggctgggcgttagcaaggcggaccctgcatgcacgatgccgataggcgccacgaacaaggcagcaatcatcacgcccagcgctgcagtctggataccattgtcggccccggccttttgcccgaacagaatatagagcgcccagcacaccccggcccccaaggcataacccgcaccgatcaagtcgataccagcgctcgtatcgctggttggaatcaacagcagcagaccgataatcgccagggcgatccagagaaagtcgatggcttttcgcgaagcataaatggctacggcaagtgggccggtgaattccagggccacggcgattcccagaggaacgctgcgtagcgacatatagaagagaaagttcattccacccagcgccatgccatagacgatgacggtgcgcagggacttggcggtgagcttcgcgcgccatgggcgcaatagcagcagcatgatgatgctggcgaaaatcaggcgcaatgtggtggtgccttgtgcgcccactatcgggaacatgcttttggccagtgaggcgccggactggatggacgccatggcaataagcagcagtcccaccgggaacagggtcgaggctaggctgcggggctggtcattcatggcaaggcatcatccgggtcaggggggaggtttggtgcgccgacatgatgcttaactaaaaacgcttgagcaatatattgctcatgatgtttctgttcttcttatatagagaaggattcatccgtttttgcaggttattgatagaaaagacaaattaggggttgacggcagattctggaagtctataattcgccccacttccggcgcagtcgaaacggaaaactccttgagattcaacgagttacacggttttcgacagcggccacgcttcagttcatcgaagcccgaaggagttgattcggcagtatgttttcgccgggttaacgattcgatcttctcggtcgaaagcggagaaaaagaggtgttgacagcagcgtgtaacgctgtagaattcgcctcccgctgacgagagatcggaagcgcaagtggttgaagttgcaaaggaaactttgaaagcttcttaaaataaccgcttgacagatacagaggctgctgtagaatgcgcgcctcggttgagacgaaaggcttaaccaaccgctctttaacaactgaatcaagcaattcgtgtgggtgcttgtggagtcagactgatagtcagaaagattatcagcatcacaagttactccgcgagaaatcaaagatgtaaccaacgattgctgagccaagtttagggttttctcaaaacccaaagatgtttgaactgaagagtttgatcatggctcagattgaacgctggcggcaggcctaacacatgcaagtcgagcggtagagagaagcttgcttctcttgagagcggcggacgggtgagtaatgcctaggaatctgcctggtagtgggggataacgtccggaaacggacgctaataccgcatacgtcctacgggagaaagcaggggaccttcgggccttgcgctatcagatgagcctaggtcggattagctagttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggtacttgcctaatacgtgagtattttgacgttaccgacagaataagcaccggctaactctgtgccagcagccgcggtaatacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttgggagccttgagctcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatccaatgaactttccagagatggattggtgccttcgggaacattgagacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatcccacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggttaccacggtgtgattcatgactggggtgaagtcgtaacaaggtagccgtaggggaacctgcggctggatcacctccttaatcgacgacatcagctgcttcataagctcccacacgaattgcttgattcattgaagaagacgattgggtctgtagctcagttggttagagcgcacccctgataagggtgaggtcggcagttcgaatctgcccagacccaccaattactggtgcaccctgtagcgatacggggccatagctcagctgggagagcgcctgccttgcacgcaggaggtcagcggttcgatcccgcttggctccaccattacagattggtgtccatcgtttaaagcttagaaatgagcattccatcaagttgatggtgaatgttgatttctgatctttatcagaatcgttctttaaaaatttgggtatgtgatagaaagatagactggatagcactttcactggtgtttattcaggctaaggtaaaatttgtgagtttaatcgcgaattttcggcgaatgtcgtcttcacagtataaccagattgcttggggttatatggtcaagtgaagaagcgcatacggtggatgccttggcagtcagaggcgatgaaagacgtggtagcctgcgaaaaagcttcggggagtcggcaaacagactttgatccggagatgtctgaatgggggaacccagccatcataagatggttatcttgtactgaatacataggtgcaagaggcgaaccaggggaactgaaacatctaagtaccctgaggaaaagaaatcaaccgagattcccttagtagtggcgagcgaacggggactagcccttaagtggctttgagattagcggaacgctctggaaagtgcggccatagtgggtgatagccctgtacgcgaaaatctcttagtcatgaaatcgagtaggacggagcacgagaaactttgtctgaatatggggggaccatcctccaaggctaaatactactgactgaccgatagtgaactagtaccgtgagggaaaggcgaaaagaaccccggagaggggagtgaaatagatcctgaaaccgtatgcgtacaagcagtgggagcagactttgttctgtgactgcgtaccttttgtataatgggtcagcgacttatattcagtggcgagcttaaccgaataggggaggcgtagcgaaagcgagtcttaatagggcgtttagtcgctgggtatagacccgaaaccgggcgatctatccatgggcaggttgaaggttaggtaacactgactggaggaccgaaccgactaccgttgaaaagttagcggatgacctgtggatcggagtgaaaggctaatcaagctcggagatagctggttctcctcgaaagctatttaggtagcgcctcatgtatcactgtagggggtagagcactgtttcggctagggggtcatcccgacttaccaaaccgatgcaaactccgaatacctacaagtgccgagcatgggagacacacggcgggtgctaacgtccgtcgtgaaaagggaaacaacccagaccgtcagctaaggtcccaaagttatggttaagtgggaaacgatgtgggaaggcttagacagctaggaggttggcttagaagcagccaccctttaaagaaagcgtaatagctcactagtcgagtcggcctgcgcggaagatgtaacggggctcaaaccatacaccgaagctacgggtatcacgtaagtgatgcggtagaggagcgttctgtaagcctgtgaaggtgagttgagaagcttgctggaggtatcagaagtgcgaatgctgacatgagtaacgacaatgggtgtgaaaaacacccacgccgaaagaccaaggtttcctgcgcaacgttaatcgacgcagggttagtcggtccctaaggcgaggctgaaaagcgtagtcgatggaaaacaggttaatattcctgtacttctagttattgcgatggagggacggagaaggctaggccagcttggcgttggttgtccaagtttaaggtggtaggctggaatcttaggtaaatccggggttctaaggccgagagctgatgacgagttaccttttaggtgacgaagtggttgatgccatgcttccaagaaaagcttctaagcttcagataactaggaaccgtaccccaaaccgacacaggtggttgggtagagaataccaaggcgcttgagagaactcgggtgaaggaactaggcaaaatggcaccgtaacttcgggagaaggtgcgccggtgagggtgaaggacttgctccgtaagcccatgccggtcgaagataccaggccgctgcgactgtttattaaaaacacagcactctgcaaacacgaaagtggacgtatagggtgtgacgcctgcccggtgccggaaggttaattgatggggttagctaacgcgaagctcttgatcgaagccccggtaaacggcggccgtaaactataacggtcctaaggtagcgaaattccttgtcgggtaagttccgacctgcacgaatggcgtaacgatggcggcgctgtctccacccgagactcagtgaaattgaaatcgctgtgaagatgcagtgtatccgcggctagacggaaagaccccgtgaacctttactatagctttgcactggactttgaatttgcttgtgtaggataggtgggaggctttgaagcgtggacgccagttcgcgtggagccatccttgaaataccaccctggcaactttgaggttctaactcaggtccgttatccggatcgaggacagtgtatggtgggtagtttgactggggcggtctcctcctaaagagtaacggaggagtacgaaggtgcgctcagaccggtcggaaatcggtcgtagagtataaaggcaaaagcgcgcttgactgcgagacagacacgtcgagcaggtacgaaagtaggtcttagtgatccggtggttctgtatggaagggccatcgctcaacggataaaaggtactccggggataacaggctgataccgcccaagagttcatatcgacggcggtgtttggcacctcgatgtcggctcatcacatcctggggctgaagccggtcccaagggtatggctgttcgccatttaaagtggtacgcgagctgggtttagaacgtcgtgagacagttcggtccctatctgccgtggacgtttgagatttgagaggggctgctcctagtacgagaggaccggagtggacgaacctctggtgttccggttgtcacgccagtggcattgccgggtagctatgttcggaaaagataaccgctgaaagcatctaagcgggaaacttgcctcaagatgagatctcactggaaccttgagttccctaaagggccgtcgaagactacgacgttgataggttgggtgtgtaagcgctgtgaggcgttgagctaaccaatactaattgcccgtgaggcttgaccatataacacccaagcaatttgcgcttaacagccagattgcggtgtgtgaagacgaaacgaaccgaaagttcgagaaaacacacaaactatcgcatacccaatttgctgaaacgtcgaaagacgcgtcggcacaccgaatttcttgacgaccatagagcattggaaccacctgatcccatcccgaactcagcagtgaaacgatgcatcgccgatggtagtgtggggtttccccatgtgagagtaggtcatcgtcaagattaaattccgaaaccccaattgcgaaagcaattggggttttgtttttgtgcgcggaaaaacctttccagtcaacggagagcagcgcccttcgactcaagaactacctcaagccgaaggtacccttggcgggcgttaacgtcccaggctgttgtgcgttagccgggctacccacttgccatgctgctcgccattcttcaatgcccgcagtttctccggcaactggttgaagtcgaactcaatcagcggtgcaggttgcagcagacccgatacagccccgcacatcagttgctcagcgtactgacgtagctgttgccagtcggcccggctgccgtaagcgtgaatactgttgagggccacttcgtggagtgagatcgcggtgctgaacgccggcaatggcgctgcctcctgacgatcctgaatacacaccaagtgcccgttgtaacccagcagtgctgccaggctgcgcgcctgagccccgctgacggtatcgaacagcgcatgcaggcgacgctcccccagtcgcgattgcagctcggtttgccaggtgtctgcccgatagtcgaaaaccccgaccgcgccttgcgccagcaaccgcgcatgatgctgagccgacgccgtcgcccacacccgcaaaccgcgttgtaccgccaattggaccagcaacgaacccaccgcgcctccggcccccaccaccagcacatcacgcgcacccacaacggggaccttatccagcgcctgcaaggcggtcaggccggggcagggcaggctggcggcaactgcatcatccagtgactcaggaaccggcagcgccgtattggcatcgagcaggcaatactcggcgaagctgccatcacggctcaacgactgatgataagccacccgtgtaccgatcttcagcgtcaccgcggaccccgcggccaccaccacaccaacgccatcgacaccaggcacgcggccggtatgccaatcggcatgtccccactcgatgatcttccagtccaccgggttgagggcgatcgtggtattggcgatcagcacttcattcgcacccggctgtggcaatgtcttgcggatcagttgaaggccttccaggccggctcctgcggtccagccccaggcgttgtattcagttggcatggtgaaacctcggcagtacgaattcggcaatttcctcgatggcctcggccaccgggcgttcactgcggcgcagatgcaggccgacatgctgcacgcctgcctcacgcagggcctgcagttcctcgatcagtgccaggcgcccacagcggccaccaaagcgcaggcgctgcatgggcgcatgtgggtcagcggcaaggtccagatggacgaaactgatatagggtttgtcgccaccgacctcacgccagagcgcgacgcgtcggcgatgttcgtccggggtgcccgggtaggcgagccagccgtccatgtgtgcaccgatccaggccggcgattgctggcccagcccggccaccagcagcggtgcggcttcaggacgctgtggcagcagatgcgcaccctcgggtaaacgatcctgtccttggctgtgcaacagctcgacagcatcgcgaaagagctctgcgcgctgggcataatcgacaccgaacagcggatactccatcggccggtcaccactggcgacccccagcagcaagcgaccatcgctcaactcgtcgatgctgttggcggccttgagggtcagccacggctggcgcaacggcaggaccaccgcggcggttccgagcatgatgttctgcgtgatgccggccaggtagccgaggtaggaaaaggtttcaaagacctgagcggcatcgccgaagttcgggtcgtacaccggtacgtcacgtacccatagcgcgtgaaagccggcctggtccgccaggcgggcgagggttgcgtgttgcttgaggtccggcacgccgaaggggcgaccttcggcctggcgcaggcgttggccatcgctggaccagtcgttatcgagcggcagttccaggccgacggaaaagttgttcctgccaagcaggcgttgaaaacgaggatgcatgaagggctccggcgtctcgcccgtggcaagacggtcatagggatcacagcgcagcagtatccccaggtccggcccacggaaaaatgcatgaatcggaacaacaatcttgagcgggcatcacgaatcggccgaattcttcatgaaagcaccgggacggtttttggtatcgtgcagctcgcttttcaagggaccgacattcacccgcacggatcagcgttcactattccacgagaagctgtagcaatgcctgaaccgataccgatcaaggaccacgaaaaagagacgcggctggtcaacaaaagactgttggcctgcgcgctcctggtggtcgccatcacctgcaccctgatcgggcgcctgtatttcctgcaggtggtcgaattcgactaccactcgaccatttccgaaaacaatcgggtgcacgtgctgcccatcaccccgactcgcggcctgatctacgaccgcaacggcgtgctgctggccgacaaccgccccagcttcaacctgactatcacccgcgagcgcaccaccgatctgaaaggcgagctggaccaggtggtcagcctgctgcacctgcccgccgaagaccgcgcgctgttcgacaaggcgctgaagcagtcacgccacccgttcgtgccggtcaccctgttctatgagctgaccgaagagcagatcgccgtgctggcggtcaacgagtaccgcttgccggggctggaggtcgaggcccagttcgtgcggcactatccgatgggcgcgcacttcgcccattccatcggctatgtcgggcgcatcaacgagaaggaagccaaggtcctggactcggtggagtaccgcggcacccagtcgatcggcaagaccgggatcgagcgtttctacgagtcccagctgcatggccatgtcggctacgaagaggtggaaaccaacgcccagggccgggttatgcgggtgctcaagcatactgatccgatccctgggaaaaacatcgtgctcagcctcgacgtgaagttgcaggaggcggccgaggcggccctgggcgaccgtcgcggatcggtggtggccctcgatccgcagaccggcgaagtgctggccatggtcagcaagccgagctttgacccgaacctgttcgtcaccggcatcagcttcaaggagtacagcgcgttacgcgattccatcgaccggccgctgttcaaccgggtgctgcgcggcctgtatgcgccgggttcgaccatcaagcccgaggtggcgatcgccgggctggactccggggtggtcaacgcctcgacccgggtgttcgatccgggttactaccaactgccggacgtcgaccacaaataccgcaactggaaccacagcggcgacggctgggtggacctggacgcggcgatcatgcgttccaacgacacctacttctatgacctggcgcacaagctcggtatcgatcgcctgcacgattacctggcgatgttcggtctgggcgagaaagtctccctggacatgttcgaggaggcgtcgggactgatgccgtcccaggcctggaagcgcgccacccggcgccagccgtggttccccggcgagacggtgattctcggcattggccaagggtatatgcaggtcacgccgctgcaactggcccaggcgacggcgctgatcgccaacaagggcgtatggaatcgccctcatctggccaagaccgtcgatggcgtcgcgccggtggacgaacacccgatgccgaacatccggctcaaggacccggtcgactgggacctggtcagccacggcatgcagatggtgatgcacgcgcctcggggcaccgcgcgcgacgcggcggccggtgcgcaataccgcatcgccggcaagagcggtacggcgcaggtggtggcgatcaagcagggcgagcgctacaaccgtctcaagacccgcgagcgccatcgtgacaatgccttgttcgtcggcttcgcgccggccgagcacccgcagatcgtggtggcggtgatgatcgagaacggcgaggccggcggccgggtcgcgggccccgtggtacgtcaggtcatggatgcctggctgctcgatcagcaaggccacctgaagccgcagtacgccagccctggcaaggggccggacgttccccacgcctgagtcatttgaacatcaggctgtccggcacctgctcacgaatactgagcatgtgctggatgctgtccaggaacagggtttcggcctggctcatcttctgctcccggtgccacagcagctggatatcgaaatccaccacgccctcgtccggcggcaaacgccagagcagcccttgctcgacatcccgcctgaccaggtggatcggcaggcagccgataccgaaccctgcgcagatcaggcgatagatctcttcaaagctggtggaggaagcgacgatcttgccggtaaagccctgctggtcgcgaaacagcgtcagcggtgacaggttgccccccaactggtcgctggtgaagctgacgaagttctcgttggccagctgttgcaggctcaggtcctgctggccgaacagccggtggcgctggccgcagaagtaggcataccgctcgcgaaacagcacccgctgttccagcctgggttgtggcaggcggcacagcccgacccccagggtcgcggtcttttgcagcagcgaactgatgatgtccgagctgcccatcacctcgacttccagctcgattttcgggtgggcttcatggaaatcggcgaggaactcgtcgtaatgcggcgcttgcacaccgctgacggtaaggatgcggatcttgcccaccacatcgtcgttgcggctctccagcaccgtgcccaggcgcgagatatcgccgtagatatcggtggcgatgcgcagcacttcctccccggtttccgtcagctcgaagcgccgtccgctgcgcgcgatcaacacgcaatcgagctgttcctccaggcgcttgagggcctggctgaccgccgactgggtgatgtgcaggcgcgcggcggcgcggctcatgctgccttcctggccgatcaccaggtaggtgcgcagcaggttccagtccaggcgatcgttgaggaaacgccgaccgacccaggggttggaggtggagagcggtgcgggcatgatgactccaggtagtagcagtgctaatagcaaagataaggatttgaaaattgactaatcctggcacggcggcgataaagcccacaagcgccagagagcgccgcgtgatcagccttccgcacctgcccaaaactacaaatacacagggtccttgcatgcacagcactcctcagccgcgccgagccgcggcggcggcctttatcggcacgaccatcgagttctacgacttctacatctacgccacggccgcggccctggtcctcggccaggtgttctttcccagcagcgacccggtgatgagcaccctggcggccttcggcagcttcgccgtgggcttcgttgcccggcccatggccggcatggtgttcggccacctcggcgatcgcctcgggcgcaagaaaatgctgttggtgaccatggcgctgatgggcctggccaccaccggcatcggcctgctgcccagctacgccagcgtcggcatctgggcgcctatcagcctgatcgtgctgcgcatcatccagggcatctccgtgggcggcgagtggggcggtgcggtgctgatggccagcgaacatgccccggccaagcgcaagaccttttacgcctccttcgcccagctcggcagcccggccggcctgctgctggcgttgatcgccttccgcctggtgaccagcctggatcagcaggacttccttgagtggggttggcgcctgccgttcctcgccagcggtgtgctgatgatgttcggcctgatgatccgttccggcgtgcatgagtcgccggagttcgccaaggcccgggacaacaacgaaaccgccaagtacccggtgatggaagtgctgcgcagctgctggaagcagatcctgttcgccgccgccgcggtgaccatcggctcggccggcttctttttcaccaacaccttcatgatcacctacgtcacccagtaccagggcatttcccgggcgaccattctcgattgcctgttcctggtgacgatcatccagctgctgtcccagccggtctccgcgctgctggccgagcgtatcggcgaagggcgtttcctcaagtgggtggcgctgctgtgcatggccacgccgtacccgatgttcctgttggtcggtacccagaacattgtgctgatgaccattggcatcgccctggcggtggtgattctctcggcgctgtacgcggtgatcgccggctacatgacccaggccttcccggtgcacctgcgctactcggggatctccatcgcttaccaactggcctgcgcggtcgccggtggcagcacgccgctgatcggcaccctgctggccagccagttttccggacagtggctgccgctggcagtgttcttcagcctgttgtcggccctgtcattgatcggcgtttgcggcctggcccggctgcgcgccaacccgactgtccagcacgttcctaaagaggtgtattcgtgagcaaacccgaacacatgagcccgattgaatggcaggcccgctgcgagctggcggccctgtatcgactggtcgcgcactttcgcatgaccgacctgatcgacacccacatcaccctgcgcattccagggcccgagcatcacttcctgatcaaccgctacggggtgatcttcgaccgcatgcgtgccagcgacctggtacgcatcgaccaggaggggcgcatcgtcgacccgcactacgccgggcaccgggtcaacgccgccggcttcgtcatccactcggcgatccacatggcgcgcccggacctcaactgcgtgatccacacccacaccgccgccggcatggcggtggccgcgcagaagcaggggctgttacccatcagccagcatgcgctgaagttctacggcaagctggcgtaccacacctatgaaggcatcgccctgtccctggacgagcgcgagcgcctgattgccgaccttggcccgcacaaggcgatgatcctgcgtaaccacggcctgctggtgggcggtgccagcgtcgcccatgcgttccaggagatccattttctcgagcgcgcctgccaggcccaggtccaggcgctggccggcggttgcgagttgaactacccgtcgccgcaggtctgcgcccacaccgccgaacagttcgaacgcgacgacgccgaccacatcatcgagctggcctgggaggccgccttgaccttgatcgagtcccagcgcgagtcctatctgtcatgagcctcgtggtgctgctgtcccgcgacagcctgttgctcaagcaattgcaggccgccttcgcccgttgtgcgccacaggtgcaggcagtgctggccgacgatccacgcgcggctcaggcgcaggtcgctgcttgctggtttccacccgccggcagcctggggcgcttgcccaacctgcaagtgattcattcggtggcggcgggcatcgaccacctggagcacgacccttcgtgcccggacctgccggtgtgccgggtggtggacccgggccaccgtcagggcatgaccgagtacctgcgctgggcggtgatccactatcaccgcggcttcgaccgggtgttggagcagcagcgcgaacggcactgggagcggccgctgcaacggccggcgcggcagttcaaggtcggggtcatgggcctgggttccctgggcagcgccatcgccctcgacctggccgccgccggctacgacgtgcgcggctgggcccgcagcgccaagcgcctggcgggggtacaaaccttcgtcggaccggagcagctggagccctttctcgaccaagtggaactgctgatcaacctgctgcccctgaccgccgagacccgcggcattctcgggcgcgacagctttgcccggctggcccgcggcgcggcgctggtcaatgtcgggcgcggcggccacctcaacctcgacgacttgcagcaggccctggccagcggccaactgcgcggcgccttgctcgacgtgtttgagcaggaaccgctgccggccgatgatccgctgtggagcacccccggggtcaccattaccccgcacatggcctcggcggcctcccacgattgcattgccgagcaggtggcggacaacctgcggcgtctgcaagccggcgagccgctgttgaacgaggtggacagagcccagggttactgagtgcccaggcaggcctgcaaggcttcgataaagaccgtctcggcgcggctcatgcgctgttcgcggttccacagcagatggatgtcgacgtcggcgatgccttcgtcgggcggcaggcgccacagcagcccggtgtcgacgtcggccgccaccacatgctcgggcaggcagccgatgccgtagccggcgatcaccaggcgccgcacttcctccaggctcggcgacgaggcgacgatgcgcccgctgaaaccctgctggtcgcgaaagatggtcagcggcgagagcatgccgccgatctggtcgctggtgaaactgacgaaattctcccgctgcagatcgccctcggccactttctgctggccgaacagtccatggtgcttgccgcagaaaaacgcatagcgctggcgcaggaatagccgctgttccaggcgcggctggggccggcggttgaggctcaggccgagggtcgcggttttttcctgcagggcgctgacgatgtccgagctgcgcagcacctcgatctccaggtcgacccgcggatgctggcggtggaagtcggcgaggaaatcatcgaaacgctcggaaaatatccggctgatcatcagcaggcgcaccttgccgatcacttcgtcggccggctgctccagcacgccgctgacctgggacatctgcccgtagatttcgccggccaggtggaagatctgctcgccgacttcggtcagggcaaaacgtggcccgcgccgggcgatcaactggcggcccagttgttcctccaggcgcttgagggcctggctcaccgccggctgggtcaggtgcaggcgggcggccgcgcggctgatgctcagttcctggccgatcacccgaaaggtgcgcagcaggttccagtccaggcggtcgttgagcaggcggtcgggcaggcggttggacatggcgcggggctctgggtcgaaggacagggctgataataagcagcggtaataatcagcataataaatagaaaattgactaattatagcctcgcgacgataaatccctcccatacaggcgccgccagagcgcctctgcgttcccgttctctcctgccagaaaaataatcaaaggagcacgatccatgaagccttcagcttcgccccagccgcgccgtgcggccgccgccgcctttatcggcaccatgatcgagtggtacgacttctacatctacgccaccgccgcggcgctggtgttcggcgccttgttctttccctccgacgacaaactgttcagcaccatggcggccttcggcaccttcgccgtgggcttcttcgcccggccattgggcggcatcgtgttcggccatatgggcgatcgcatcgggcgcaagaaatccctggtgatcaccctgctgatgatgggcgtggtcacggtgtgcatcggcctgctgccgacttatgcacagatcggcgcggcggcaccggtgctgctgatcctgctgcgcatcgtccagggcatcgccgtcggtggcgagtggggcggggcggtattgatggccggcgagcatgcgcccaagggccggcgcaacttctttgcttcctttgcgcagttgggcagcccggccgggttgatcctgtcgctgctggccttcagcgcggtcacccgcctgcccgaagaagacctgatgagctggggctggcgcctgccgttccttgccagtgcgctgttgctggtggtgggcctggcgattcgcctgggggtcaatgagtcgccggaattcctcgccagccgcgagcaggcgcacaagagtctgcgtaaggaacaggcgccggtgatggaagtgctgcacagcgcctggcgcccgctgctgctgtgcatcggcgccaacaccctggggattgccggggtgtatttcaccaacaccttcatgatcgcctacagcacccagcaactgggcttgccgcgctcgctgatcctggaatgcctgttcgtggtggcgatcatccagttctgcatccagcccctggcggcctggaccgccgagaagatcggcgccacgcgctttctgtgcctggtgtcgttgctggccatggcctcgccctacccgatgttcgtgctggtgagcagcggccaggcgccactgatcatcctcggcatcgccctggcggtggtgtgcatggcgtctttctatgcggtgatcgccggctacgtcagcggcatgttcgagacccgcgtgcgctacaccgcgatctccctggcctatcagatctgcggcgccgtggccggtggcctgacgccgctgatcggcacttggctggcccatcaattcgccggccagtggtggccgatggcgctgttctacagcctgatcgcgaccatttcgctgctctgcgtgctggccctggcccgccgccatgcagccgtccaccgcctggaaatggcttgagtgtttatcgaatccggagaaccgaagcatgttgaagatcaacggtgaacgcctgtgggcgagcctgatggccatggccgaaatcggtgcgactgcccgtggcggcagctgccgcctggccctgagcgaggaggacaaggccgggcgcgagctgtttgcaagctggtgccgcgaggccggcatgagcctgagcgtcgaccccatcggtaacctgtttgcccgccgtccgggcagcgaccccgacgccgccccggtgatgatgggcagccacctcgacacccagcccgaaggcgggcgcttcgatggcgtgtacggcgtgctcgccggcctggaagtggtgcgccgcctcaacgatctgcggatccagacccgcaagccgctggaggtggcggtgtggaccaacgaggagggcgcgcgtttcaccccggccatgttcggctcggcggtgttcaccgggatcatggacctggagagcgccctggcggtgcgcgacgccgacggcatcagcgtcgccgaggccctgcacgccaccggctacgccggtacgcggcccctgggcggggcggtggatgcctacttcgaggcgcatatcgagcaggggccgatcctcgaagacaacgccaagagcatcggcgtggtcagcggcggccaggcaatccgctggctcgacgtgcaggtcgaaggtatggcggcccacgccggcaccacaccgatgccgctgcgcaaggacgcgctctacggcgccgcgcagatgatcctggcgatcgaaaccctggccacggattttgcccccgagggcctgaccaccgttggcgagctgagcatcgccaagtcttcgcgcaacaccattcccggcctgttgcagttcaccgtcgatctgcggcaccaccgcgacagcgccatcgccgccatggagcaggaagtacgcgcgcggcttgctgccatcgccggacaacgccagctgaaagtgaccatcagcccgcactggatcagcccggccacgcccttcgatgccgactgcgtggcggccgtgcaacaggcggtggacagccttggctacgctcagcaatcgatcgtcagcggcgccggccatgacgcaattcacctggcgcggttctgccccacggccatggtcttcatcccgtgcgtcggcggcctgagccacaacgaagccgaagacgtattgcccgaggatgtgcgccagggcaccgacgtattgctcaacgccgtgctggcccgcgccggccgggtcgaataaggagaaggtcatgcgcagttttttccaccccgaacagcttttgcactatccgcgcagctattactcccgcggccagatgcgcacgccacaggaagtgcccgagcgcgcccagcgcctggtccaggccgcgcactccctgggttttgacgtacagcaaccggaggacgccggcctgcaaccgctgctggcggtgcatggtgcggcgtacctgcagttcctcaaggaagcccaccagcgctggaaggagattcccgaggactggggcgacgaggtgatgtcgaacatcttcgtccgcgagcccaacgccctgcgcggcatcctcgcccaggccgcgcgttacctggccgatggcagctgcccggtgggcgaactgacctggcgttcggcctactggtcggcgcaaagcgcgattgccggcgcccgcgccttgctcgacggcgaaccggcggcctacgccctgtgccgcccgccgggccatcacgcccgggccgaagccgccggcggtttctgctacctgaacaacgcggcgattgccgcccaggtactgcgcgaaaaattcgcccgggtcgcggtgctggacaccgacatgcaccacggccagggcatccaggaaatcttctacgaacgcgacgacgtgctgtacgtctcggtgcacggcgacccgaccaacttctacccgggcgtcgccggtttcgccgacgagcgcggcagcggcgcggggcagggctacaacctcaacctgccgatggcccacggcgccagcgaagccgatttcctcgcccagctggaaaccgccctggcggcggtgaaaagcttcgacgcgcaagtgctggtgctgtccctgggcttcgacatctacgaactcgacccgcaaagcaaagtggcggtaacccgcgcaggtttcgcccgcctcggcgaacgcatccgcagcctcggcctgccgtgcctgatcgtgcaggaaggcggctaccacctggaaagcctggaagacaacgcacgggcgttttttgccgaggcgggggcctggaagctctgagcgaggggattgtgagatcgcttcgcgggcaagcctcgctcctacgcaagcgcaggcgtcgccgtccgtaggagcgaggcttgcccgcgctaaacgtcaacgataacgcgctgcgtctgcctgtccctcatgccaaagcccctgaatcaaaagatccaggggctttttaatggttcttcacggaatcccgggaaacacagaaacaagaacgccgatttgattgatgatgttcgtgcgagcaaacacatctaacaaaccggcgttcttatgcgtgatattaatactttccttcccttttgggagggcttttctgtcgtcacgatcaagcctgatggtgacgcgctccagatcgatctgattccccacgccacccgattcccttcctgtggcggctgccaaaaactctgttcaaccacgcatgagtactgccagcgagtcatccgcgatctgcccattcttggccgagcagtgcgcctcagcgttttgcttcggcgtgtcggctgtcgggactgtggcaaacgcatggaggccgtcagttggctggatcgctatgcccgcatgacgcgccgcctggccgatgcggtcattcaggcctgcgagcgccttcccacgctacacgtggcccaactgttcgggttgcattgggacagcgttcgcttgctgggaacgtcgcgccttgcaagcggcattgagtgttttgccaaaggcgcagccacagcgcttggtcatggacgaatttgccctgttcaaaggtcatcgttacgccagcgtagtgctggacgccgatacccggcgagtgctgtggattggcgaaggccgcagccgggcggcagtcagaccctttttcgaagagctggggtcagagggttgcgctcgcatcgaagcggtggcgatggacatgaacactgcctttgacctggaggttcgtcagcactgcccaaaagcgcgcgtggtctacgacctcttccatgtggtggccaagtatggtcgagaggtgattgatcgagtccgcgtcgatgaagcgaatcggctacgtcacgacaagcctgcccgcacggtcatcaagcaggcgcgatggctgttgctgcgcaatcggcagaacctgaaaacgccggaacaacaagtccgcctggaggatctgctggcggccaaccaagcgttgatgacggtctatttgatgaaggctgaactcaaaacgctttggacaccgagcaccgcctggggctggcgatcagcctggcgacaatggctgcgccatgcgcatgaaagcgacataccgcctctgatccagtttgccaaacgactgaagggttactggcggggcatcgtcagccgggtgcgctggccaatgcatacgggccagttggaaggcatcaacaatcgaatcaaggtcatcaagcggatggcgtacggttaccgggacagcgaattctttttcatgaagatcaagagcgtctttcccggtaatccgtgaagaacctttttaatacctgcaacaggctgtcgcagaggatgttgaaagaggcctcaaacgcttacagacgacccgcctccggcccttgcatcaccttgccctggacaacatccagcaaggtcagtcattcgctgaaaaaactgacgtcttcttccaattctttccaaggggtttaggacgtttcctagattaatgccgtgggtgacttgctagcctggctcggctgttcagcttggtcgcatctggatgtggccagggcaaaaaccagttgcgctgacatgaagtcggcgcacaagagctcgcgctatgtcgcagtcaaaaggaacaaaggaatgttcaacaacgccaacgaaactcacttcagcctgaccatcgacgacttccagggtgacttgcaggtgctgtctttcgaggggatcgaaggcatcagccagccgttccgtttcgacctggagctggtcagcgagaaccccgacctggacctggaaagcctgctgcacaagcaggcttttctagcgtttgatccgcaaggcagtggcatccacgggcagatctaccgcgtggcccagggcgatgccggcaagcgcctgacccgctacaaggtgtcgctggtgccgcaattggcctacctcgaacaccgcaccaaccagcgcatctaccagcagctgtcggcgccgaagatcatcgcgctgatcctcgaagagcacggcatccagggcaacgcctaccggttccagctcggcaccccgtgcccggagcgcgattactgcgtgcagtacgacgaaaccgacctgcatttcatccagcgcctgtgcgaagaggaaggcctgcattaccacttccagcacagcccgcagggccatctgctggtgttcggcgacgaccagaccgtgttccccaagctcggccagcccaccgcctatatccagggcagtggcatggtcgccgacgagccggtgatcaagggtttcaacctgcgcctggaaacccgcacccgccgtactactcgacgcgattacgacttcgagaagccgcgtctgcaactggaagcggcctataaacctgagaccgacagtgaagagccggacctggaagactacgactacccgggccgcttcaccgaccgcgcgcgcggcaaattcctcagccagcgcgccctcgaacgccaccgcgccgactaccagcaggctgaaggctggggcgaccagacgcggctggtcagcggccacttcctggaactgtccgagcacccgcgcagcgagtggaacgacctctggctgctgacccacatcgtccatgaaggcaagcagccgcaggtgctggaagagtcggtgaccagcgacaccaccgacaacaaggatgacttccaccagggctatcgcaaccgcttcctcgccacgccctggcaggtgttctaccgcccggccctgaaccacccgaaaccgcgggtgctgggcagccagaccgcggtggtcaccggacccaagggcgaagaaatccactgcgatcagtacggccgggtcaaggtgcaattccactgggaccgcgaaggcaaggccgacgacaagaccagctgctggctgcgcgtgtcctccagctgggccggcgaccgttacggcgccctcgtcatcccgcggatcggcatggaagtgctggtgaccttcctcgaaggcgaccccgaccagccggtgatcaccggctgcctgtaccacaaggaacacccggcgccttacgccctgccggcgaacaagacccgcacggtattcaagtccatgagctcgccgggcggcgccggctacaacgaactgcgcatcgaagacaaaaaaggtgccgaacagatcttcatccacgcccagcgtgactgggacgaaaacatcgagcacgaccagaaaatccgcatcggccacgaacgccacgacacggtggaaaagaacacctacaccgaactcaaggccgaagaacatcgcatcacccacgccgaccgcaagaccgaaaccaaggtggacgaccacctgaccgtgggcgaaaaccagcacatcaaactcggcacggcccagctgaccaaagccggccaggaaatccacctcaaggccggggccaagatggtgatcgaggcgggcagcgaactgacgatcaaggccggggggagttttatcaaactcgatgccggcggcgtcacggtggtggggccggtggtgaaaatcaatgccgggggagcgccggggagtgggaccgggattgggatcaagccgccgacgttgccgggggcggcggataaggataaggcggggagtttgatggatggagcactgttgaatgcaccggaagaacagatcaagcgcaggccgaagcggatgctcaatttctccggctaaccgacaccatcagagcttccagtcaccaaggatcaggatttcaggtaagtagttatggcagagacaacaagcagcaaggttgaaaagtgggcataccctctgaaagctggagcttcagaggtcacagattcgatgcagtattacaaggctttggccaaggccaaggatgggtattacccgcttggttccaatggcttgtggcacggaggtgttcatttcgatgaggacaccgggttagtcgcagacaagagcgaagttcgttgcatcgccgatggcgaggtggtcgcttatcgaattgatgagaagtacccgacctcgaattacggttcgacgccgtcagtattctcgaccggtttcgtgttggttaaacaccgtcttgagctgcctgcgcctcctgctccggtaggtggcgcaccggcaacgacgccaccagttaccggcccaagcctgaccttcttcagcctgtacatgcatctgctggactgggagggctacaaggccaacccgacgcttcaaaggcctgccttttggggtaacgacacttatcaagtcaaagcaaatgcgccagacaagtcattagggctgcgagttcgtagcggcaactcagggcaaacctcggtattgacggttctaccccgtggcaccacggtgaacactaaacctgctccagcagcacaaaaatggctcgaaatcgtcagcgtgacccctgaagtcgcagctctgccagcgaatacaggttgggtgttcaaaggtgaaatgcagcatctttccggagatatttattttgtaggagaacaggccaaggacgcccctccagagcagaaaaccggggcgaacatccgcagtgccacggcaagagggctacctataggttttttacctacaggcacgcaaatcaaaatcagcaatgaacaagcttctggcaaatatcgcaagctactggaaattgtcaccggcgaatccatccctgcgttaacaccgggtgcagatggaacattgcctgggtatgtctggcttgactctcttgaggcaaaaagcgaacccaaaacccctggggtgattgtcccgttgacaccggttcataaaatcaaagccggtgagctcatagggcatgtggggaagtatcagaattactcggacgcagctccgaaaaatttactgcacctggaagtgtttagctgtgaggacatcaaggctttcatcgaccagaccaaagagcaggccgtcagactgccagcaacagaaaagacactggtcaaaatcctgccacacaccccgctgattgctcatgtgccgggtatgaatgctaccaacccccccaaagcgaacgatgctagcaaagaggtcggttatggcctgctcattcctgtgagcgtattggaagccctgccagcagagaaaaaaatcaaagctccggtggtgatggatggagtcactacctatacgcagtggtggcacctggaagggctactcgccgatgctcaaggagagagcatcgacggttggtttgccgagcctaataccacgttgtaccgccactcgccttttgaatgggaaggtttcaccttcatcgaagagactgggagcaatgtcgatctctacgcggattttctgcatgcgcaagagaatatgaccgatgaagagcgcaaggcttaccacccaaatatcgtgactgccggggcaggtccgacaaaacaatctctctacaccatccttgatcgaaatcgcgacacgaaacttccaccggaagagataagaaataccctaagcaagccttggtttgcccaaccggtctcacagatgattatcaagtatgagagtgagtgggactaccaggcagcgaagtgggactcattggatgagttgatggggcatagcgagtcggcgccacataaggagtgggttgccgagaaggcgcgaattgatagcctgagttggtgggaaaagcttgggataattgatagtgccaaagtatggcatatgcaccctgttggtttgctgggagccttttgcaaactgaagagctcaagtggaagcttggggaaggtcacatatgatgcagaaggtaatgatatccctacgtcgcaatttttcagcagggtaatacattggccaggtaatgctgagtcaggagttactttagggcgaggctatgatatggggggaccgaagtgaaagctctatatatgagcatatggttgcttcgggggttccatctgctcaagctacgaaaatatctaaagcccgtgggttaaaagggatcttggcaagagattttgtggcggcgaataaacaagatatcggggagatcacgcttgagcagcaaaaggcactttttgatttgatttatccagattacgtttcaagaacaatagtggtttacaatagttggacctctacattgccagggcgtatagagtgggaaggattgcggcagatagtaagagacatactggtggattttgtttatcaaggattcacccaaggtccaaacccaatgaaggcagggatgaatgatgatgtggatgagcttattagatgtatagaaaatacccctgctataagtcagtatgaaggcgggcggcatcgtgctaattatctaaggaataataggtgatgagagttttttttgattgttctaggaagttcattttgctttctctgcttgccattttgtcatcttctgctatagggggagagtgcgataatattacattgagtgcccaggttgacctgtgtgcaaaagaaaaaaaagacagtgcggatgcgaagctgaacgaaagctacaaagatctcataagtcgagttcgagtccagtatgaagctaactctgaattaggtggcttgtatttggagaagcttaaggggacgcagcgtgcatggttgaaatatcgtgatgctaattgtgatctggaggcatttgaagtagaggtagggctgcctgctcagataacgatagttaataattgcgtggctcgaatgagtgaggagcgtaccgcttatttgaatggggttatgaattgatttttagtaagggggcagcttcatttgaggagacgctgaaatgcaaacgccgggaataagtggtggggcgtaacttttttagagtgtctaatggcaatagttagccccatgagtaggcttcaaatgttggaaggtgttgccgtggagtgcgctagggctgttattggtcatggcgggtcttgcggcggtggtcaagctgggtgttgtttgaggttatttacgagagccacaaatgagtacctctgagattgctttcgggtatctgggtggcgtcgtgattctcggcacacttgtctggatcggtgtcgcgttgcacatggcttataccaagctggatgagctcttggaccatctgaaaaactgttccgccatcatggcccgcgctccgttaaaacacggcggtccctgggggaagcttttgctgattggggggatctccgggaccgtgacgtttcccgggttccatctcaaaagaggggagacggaaaccatcgtgacgccgggcctggccaatggcgcggcgacctttacgattatttatccgcgatgaacggcatacctcctgccgggaggccggcaagagacagcgcggctcagtcgtagttgctcacataagccaggatgccctgggcgcccagggcgttaccgttgaaacgggtcgcctgcagcagcacggcgatctggttgtcgctggcgacggcttttggaaaggtattgccgctgtcgttcgggttgatcgatgtttccgccgccaaggggatgaaggcgtcatcgaaccggttgaaaaagatgccggtataaccggtactccaggtcaccaggaagtcaatgacaccgcatgtggccggcatggcactgatatagggctggctcgaggcgtagacattgttgttcaggcgaacgggggagagggcttgcagttcctgatcgctttggtactgctcagcctcagactgatcagccttgccgaagacccggactcggtcgccatagacataggcgctggtgccgatataaaccagcatgatgttgttgtgcgcggtgtcgaaggttgcatggaacttgcccatgccggtttgcgagtagctggtcatcagattgaccggcgatttgccggaggtggggctgcccactcgcaggaaattgatcttgctcagggtttcctggacgccgacgatcaccccgtcgccatggttcatcagcacgatattttcgtaggtggaagtgtccagatcggcaccgggattaaacagggtcggatagacggcagaggtgatcatcaccggataactggtcggctcgagggtgtccttgtccagccagatgccttgcaactggcgttcggtcacgccgatccagcaggcgaagagctggcagttggcggggttgtagatgaccctggggcagacgtaatcaccgttggagccactgatcagggtttccgtgaagggcgcgccgataccctggcgctcgctgacgctgtatttgcgcgcaaagatgcgaaaggcgcccgggtcgttgctggcccagacggcaacgaagtcgtcgctgccctggatcggcgtggtatcgacatccttctgggtccgctgggtgaaggcgggaagcagatagctcgggcgtagcgtgccattttttgtctccaggcggccatagagcgtggtgtagccggaagccttcggcccttgataggtgccgaccaggtgaccgctgacatcggtcttcagcacgccgcgcagggattcgttgctgctgtcgtcatagaaaatgttcaagccgttcaaccatttggtattcattcaggcacctgtgactgtttgaggagtgtcttcggaacaggaccagccgaccgtgcagggcaggcaggggtcgtggtacttgccatcgagccttgaccgcaacgcctcaccgcaactcggttccagggtttgggtatcgaggctggcgagacagtacttccagggcccatcggtgcgggcgtcgatgcaggcgaaatagaagtgctcgcccgatggcaccagattgatcagcagtggcgaagttatagtggggaagtccagggagaccggtgctgaaaccctgatgcctgtagctagcttttcgggaggtcgatttagtggggcgtaggtgacttttctgggcggcttgaagtgtgcaagctgacggtcttgataggtcgtagaagtgcggggcaatagtgtgttccgacgcatgacttcgacctccttgtcgactcgcgttctgtccgttcgcatccagcaagatcagcgtagtcattattttatagtgcccgataatatttttttatttatttaaaacagtaagatgcctctgaagttttgagcggttacaggtttgtcggataactgacttggcctgggaaacggtggtgttactgggtggctataaagataagtgcgagtggtaatagtgcgatgttgtctttataactccgctaaagaatgaccatggcttcttgtaagtattggcaataagtcatttcagaatataaagggacttagttggcagcctgtccgcactacctgctttatgttccccctgttcagactgatcatttactgggccgtttaccgccaggcgagcagtgagtacaggggcaaccggacgccatacggcacttgccatccgctttacgttaacgtcaagatgcttcggcgcggtttgtcccgtggcgcaggttttgcttctgtgaatggcagggctggccacgggccaaacttccctttactgccttctgaaccgggtgtagacattgcccatggcttgcgtgcccctcgcaacccaagggaatggaccggggaggtgccgggcggaccgattcggagcgcttgatgacgcttataaaaacaacaaccggtgagctgcagcatcaagccgggctggcccgcagaaagctccatctggaaggcgcagtccccgatggcgtattgcgtgcggaaatcgatgcgtcatggcggcgcagcctcagccatggcgtgcacttcaatggccagccggagctgaccctggaatccggcgccagcctcgaggtgctgctggcgagcaatcgcctgctgctcgacgcggcaatacccgccatcgactacctggccgagcgccagggccaggacggcctgattatcctggccaatgccgacgccaccattctgtcgatcgaaggccgggccgaccggctcaagggcagcggcgtgcaggacatcaccctcggcgcctgctggagcgaagccacccgtggcaccaatgccctgggtacggcgctggtggaagcgcgcacgaccctgatcgactgcggcgaacattacctggatcgcctgagccatttctcctgcacctcggtgcccatccattgcccccagggcgagatcctcggcgtgctcgacctgacccgcgaaggcccgctcggccgcatccacgacagcaccgcgctgctgagcatggcggtcagccagatcgagagtcgggtgtttaacaacagctttcccgagcagattgtcctggcgttccacagtcgtcggcagtatctcgaatcgccctggcaaggcttgctcgcggtcagtctcggcgggcagatcctggcggtcagtgcccaggcctgccagttgttgcgcgccgagcgttcggcactggtcgggcggcgttgtgaagagtttctcggcgtggatggcgtgcaactgctcggccgtttgcaacagggtggcatcggcagcctgcagaccgccaagggcgagtttttctacaagaccctgcgcgccccgcaacgctcgatcaacctcagcagcgtgccgcgcggcacgtcgaaaaacgccccgagccaggcgcagcccgacccgcaactcgacaccttggccggcagcaacagccgttatgcccgggccttgcgcatggcccggcagggcctggccaatgccttgccggtgttgctgctgggggaaaccggcaccggcaaggaagtcatcgcccgcgccctgcacctggctggcagccgcgctgataagccctttgttgcggtcaactgcgcggcgattcccgagggcctgatcgagtcggagctgttcggctatcgcgagggggccttcaccggttcgcgccgtggcggcatgatcggccgcctgcaacaggcccatggcggcaccctgttcctcgatgaaatcggcgatatgccgctggccttgcaggcgcgcctgttgcgggtgttgcaggatcgcaaggtggcgccgctgggcgccggcgaagagcaggacatcgatgtggcgctgatctgcgccacccaccgcgacctcaagcagcaggtggccgacaagcagtttcgcgaggacctgttctaccgggtcaacggcatcagcgtgatgctcccggcgctgcgcgaacgcgaggacttcgacgcactgctggacgtgctgctggccaagctcggcagccccgacgcggccctggccgaggacctgcgccaactgctggccggctatcactggccgggcaacatccgtcagctggagatggttctgcgcaccgccctggcgatgcgcgaggagggcgaagcgaccctgagcctggaccatctgcccgacagcatgctcgacgatctcaacgccagcgaacgtccggccagcggcagcatccgcgagaaccagctggaactgatccgccaggcactggacaaccaccagggcaatgtctccgccgccgccgatgccctgggcatcagccgcgcgaccctgtaccgcaagctcaagcagttgcgcagctgatgtcgcgtctgctcagccggctggtggacagccccgaccccgcggccctgcaagccgccttgcgctggctgtacgggtttgtccgcccgcagcgcctggccatcgccgggttgctggcgctgtcggtctgcgcttcgttgctggtgctggtgcagccgtggctgaccaagctgctgatcgacgacggcctgctggcgcgcaatttcccgatgctggcgtggatcgccgggctgatgattctcgccgggctgctgggcaccgcgttgtcgggcatcaaccgctacctgcacacgcgcctgtcggggcggatcctgttcgccctgcgcgacgacctgtatcggcatttgcagcgcctgtcgccgggcttctacggccagcggcggatcggcgacctgatgtcgcggctcgatggcgacgtggcggagatccagcgctttgccgtcgattcgctgttctccgcggtgtccagcgtgatcggcctggtggtggccctggcgctgctggtgaccctgtcctggcagctgtcgctgctggcgctgctgctgattccgctggatgtgctctggctgcgctggatgcggcgcaaggtcgagcgcgatgtgcggcaactgcgcgagcgttcggcggacatgtcgtcgttcatggtcgagaccctgccggtgatgaagttcatccagagcgccggccagcaacagcgcgaggcgcggcgcctggagcagttggggcagggctacatgagccagttgctgcgcctgcaggtcagcgagttcttcacccaggcggtgcccggcaccctgacctcgctgtcgcgggcctgtgcgttcctgattggcggttattgggtggtgcagggtacctggcagttgggcgcgctgatcgccttttccacttacctgggcatggccgtggggccggtgcagagcctgctggggctgtacgtggcgatccagcgcatgagcgtcagcctgggtcgggtcatggagctgcgcggcgaacaaccgagcgtgaccacgccggagcaaccgctgccgatgcccagcggcggcgagctgtcttttcgtgatctgcacttcagccacccggggcggccgagcaccctgcgtggcatcgaggcacgcattccctatggcctgaaggtggccctggctggcggttccggggtcggcaaatcgaccctgatcgacctgctgcaacgccaccacgacccgcagtccgggcaggtgctgctggacggtatcgacctgcgccagctcgacctgttcgagctgcgccgacgcatagccgtggtcagccaggacatcgtgctgttccgcggcagcctggccgacaacctggcctacagcgtgcccgacgcaccgcgcgcggcggtggccgaggtggcgcggctggcgcaactggacagcctgatcgaatcgctgcccgagggcctggacagcccgttgggcgagcgtggccagcagctgtccggcgggcagaaacaacggatcgcgattgcccgcgcgctgctccaggacccgttgatcctggtgctggacgaagccacctcggcggtggacgaaagcactgagcgcgaagtgatcgaggccatcgaccggctgttcgccgggcgcacgcggatcctgatcagccatcggccgtcgaccctggccgacgccgacctgcgcttcgagctggtggacggcgtcttgtactccgtgaaggtgccccatgaagcctgagctgcggatcggcgtgatcgacagcgggcatacggctgtgcaacgcctgcaggtggtggccgggcggcgcttctacctggtggaggacgggattggcgagggcgacttgcgcgaagaccccctcggccacggtagcgcgatcatcgaggcgatcagcgcgcgggcgccccaggcgcgtttctgtgtggcccaggtgttcgaccagcgcggggtgaccagtgcgctgcagatcgccagcgcactggactggctggtgagccagcaggtgcggctggtcaacctcagcctggggctgcgccaggaccgccgcctgttgcgcgaagcctgcgcggccgccctggcccgtggcgtgctgttgtgcgcctcgacgccggcccagggcgagggggtatttccggcgcgttacccgggggtgctgcgggtcaccggcgatgcccgttgcacccccggcgaatggtcgtggctcgacagccagcaggccgatttcgccgcctgtgtgcagggcagccaccccggccagtccggcgccagcctgggctgcgcggccttgagcgggcatatcgccggctacctcggcgaacaccgcgacgccgataacccgcaggtggtccagtggctgcggacccacgcccgctatcacggccccgaacggcgcggctggacatgaagccgatcctggtgctcggcgccggcccggcgggggccgcggtggccctgggcttgcgccgcttgggttacgcggtggcgctggtcagcgagtggcggcgtttcccggcgctcgaaggggtgtcgctgcgggtgctcgaagccctgcgtggcgccggcctggggcgtgggctggaggcggcgttgcaggcgtcccagcgtcaggtggcgtggaacggccagagccatgcacagaacgtcgaatacctgctggatcgcccgcgcttcgatcgcggcctgcgcgaggatctgcgcgaggccggggtcgagctgatcaagggccgggtgctggaggtgcagtcgacggcgaacgggcgatcggctgcggatcgaggggcaggccgagcatttcgcggactttctggtggaggcccgcgggcgtcaggcgcctgcattgagtaaagaactgggcaaaggcctgcggggcccggaaaccctcagcctgctcaaccgctggcagggcgcgccgggcagcactgccagcgccgtgcacagcctggaagacggctgggcctggatggcgcgccaggccgacggccagtgttactggcaactgacggtggacgtggccagcgccgcgctgccgggcaaggcgcagttgctggattactgccgccagcgccgccaggcttcggccctggcgcgggcgtttttcggcgctgggccgcagctcgatatgcaactgcacgcgcgcagcagcacggcgatcctctacccgcaggtgtgtggcgccaactggattcgcgtgggcgatgcggccatggccgtggacccgctgtcgggcaacggtatcttccagtcgctgtcttcggcgttgcaggcgccggcggtgatcaacacgctgctgcaacggcccgaacgcgaggccctggcgcagcgcttccatgcccggcgggtggagcaactgttcctgcgttttgctcgcatcggccgcgatttctacgccgacgagcagcgctgggccgaacagccgttctggcaggcgcgccggcaatggccggaccgcgagccggcgcatcgcgtcgcggatttttccgccctgcgcatcgagcgtgccccggtattgcgcgatggcctggtggacgaagccgaggtggtgatcaccccggaccagccgctgggcatctggcatgtgcaaggggtggagctggcgccgctgttgcgccgcttgcccaacgaaccggcgcaacagctgctggcgggcctgagcgcggagcaggacaaggccgtgcgcggctggttgctggggcagggataccagccttgaggcgacggggcggcttttgtagccgctgtcgcaggctgcgatcggcggcgcagctggcgtaaaggtgccagcgatcgatcgccggatgtgtggtgcctggacgattgatcgcgagcaagctcgctcctacagaagatgagacgcccttgtaggagcgagcttgctcgcgatccgcgcagcggccatccaaaccccgccgcccggcttgcactggctaacaatcagctatcgggattgacgtacacccggtggccgcctttccaggtttcacagaccttgatgtccctgatgtgggtggccggcactttctcgtcgaggggatcctgctcgagaatcaccaggtccgcgaaataaccgtcctgcagggacccggtccagccttcggcgtggcactgccaggccgcgtcataggtgatggctttcaaggcctgcttgcgcgtcaggcactcggcttcattgaggatcggttgcagccttgggtcgtggacgaaccgcccctgggcatcgcgaatgccttccatcttgcgggtcaccgcctgttccatggagcgcagcggccccaacggcgttaccgaacagtcgctgtgcagggtcactctcaggttgtggtccagggccgactggcacaggtcgagcatctgctcggccttgccttcgaagatcgcctgtttgaaggcgtagccccagtagccgacatgaccgatcaggaagcttggcgacaggcccaggcgctgcatggcctgcagggtgcccgcggtcagcagcgagcagtgctcgatgcggtggcgtttttccagggcgctgccgccctgcaaggccgcctcgtaggcttgcagggtgaactcgacggcccggtcgccgttggcgtggatcatcagcggccagccagtttcgacggcattgcgcaccacggtcttgtaggcatcgggtggggtgaccggggtgtggtcctgatcgcagaagttgaagttgcccaccggccgcgtcgcctcgcagcagtagcgcgtggcctggtagcccgtcagcccctggttggagccgtccgacaccagcttgaccgagccctggtagaagcgcttggcctgttcccggctgaccggctggtagcgcggcagcttgccgatggcctcgggcgtgccatcgcaggcggcggcgtaaccgatccgcagcttgcgggggcgggtcaggaagtaggcgcccagtaccagcttcgactgggggtccatcatcgcgtcgtagagcagggtgatcccgcggcgcgaagccttgtcgaagtagtcttccaggtgcttgaagatattgagtatttccagctgctgcctgaggggaatgctcttgatggcggccagcacctgggcttcctgcaggacaccgttgtcggccctgacgcctgttttctcgaacaccgcatcgctggccgcggtgttcaggtaggcggtgtgcatggacgcgctgatcagcagcatcgggtgctgcttgtcgatggtgtccaggttgccgatgtcgtcgccggggccacagtggaaggtgatgagtttgttcaggccatggggtacgacctggaacggcatcagcgccggatcgacctgatggccgaggatccaggccgagttgtccttgggcaggttggcctggatggtgcttttcaaccagagccagtcataggtgggccgtagccgctggttcttgtgctcatcggggttgtcggtatcgatggcccccaggttcagccagccttccatggcacagctctgcacgatatgggcgtggggttcgatcaggccgggcaacagggtcttgccgttcaacgactgctttttgtaggtgatgcccagggcgttcatgcgggcttcgacggcggccagggtgccggaggtgaccacgtcgccggcgtggatgcccagggcctcgacccgttcgtccatgttgccgtcgcgcaaggggtagatggtgccgttggtaaagatgatggactcgccggccggttccctggccagctcattggcgtcctgtggctggctggcggtatggttggccgggtcgagtgtgtccttcagagcgttccagatggggttgtggcatccgcattggaccccgtcgtgatcatatccatttgatcccatgatgcttccctcgggttttcggtggtgatgaggtgtgggttgaaggtgggtgagccaggctcgcaggggagctgtcgagccggctcgggctgagcgtagcagccgttcggggcgcgggccgggcagcgggtcggcgacgctaaaccagtcgtcgggagacgccggcgctcccggcgagcagcgcttgcgctatgggctattgcgggtcgtcagagcttgatcagcaccgatttcagctcggtgtaatgctcgatcgccgcgtaacccatttcccggcccacgccggacatcttgtagccaccgaacggcagcgccgggtcgagggcgctatggcagttgacccagaccgagccggacttgatccgcgggatcatccgatgcaccgccgccaggtcgttggaccagatgctcgcgcccaggccgtaggggctgtcgttggccaggcgcagggcatcggcttcgtcgtcgaagggaatcgccaccagcaccgggccgaagatctcttcctgcaccagcgaatgctgctggtcgacgtcgactatcaccgtcggtttgacgaaataaccggggccgaaccgctcgccgccgcaggcgagggtggcgccgctgtcccggcccatctcgatatagcgccagacccgctcctgctgccgggcggagatcagcgggcccatgtcgacgctggtgtccaggccgctgccgagcttcatggcgttggcgatgccggcgatatcggccaccacattgtcgaaatgcttgcgctgcacatacagcctggagccggcgcagcagacctggccctggttgaagaagatcgcgctggcggcgccggccgcggcgctgcccaggtcggcatcggccatgacaatggtcggcgacttgccgcccagttccagggtgacccgggtcatgttgtccatggcgatcttgccgatttccttgcccaccgcggtggagccggtgaaggtcagcttgtccacccgcgggttgtgggtcagggccgcgcccgcggtgatgccggtgccggtgaccacgttgaacacgccgtcggggtagccggcttcctgcaccagctcggcgagtttcagcgcggtcagcggggtctcgtcggccggcttgagcaccacggtgcagccggtggccagggccgggccgagcttccagcaggccaacagcagcgggaagttccaggcgacgatggcgccaaccacgcccaccgcctcgcggcggatgaaactgtggaactgctggtcgggcatcagcggcacggaaacctcgacgctgctgccttcgatcttggtcgcccagccggccatgtagcgcaaaaagtcgatggccagttgcacgtccatggcctgggccaccgcggcgctcttgccgttgttcaggcattccagttgcgccagcagctcggcgtcgcgctgcatcaggtcggcgagtttccacagcaggttctgccgttcccgcggccgggtgcggctccagggcgaatcgtcaaaggcctggcgcgcggccagcaccgcgcggtcgacatcgtccaccgtggcccgcggcaccacgcacagttgttcgccggtggccgggttgtgcagcggcatggtctggccgtcggcggcctcgacccattcggcgccgatcagcatgcgtggggcgcgctggataaaggcggtggtggcggggagcagggttgcaatagccatgacagaacctcttgttatgcgtgaggggagggctttcgcaaccgctgtgccagttttgactggcgcttaactctatgattctaatggtgtttatttgagatgacggaagggcggcggatacaggctgtcgcaaattgcgaatgccttgagacaccccggcctgaacttatgggggcctgcttcgtcgtaaaggggcctgtcatgaaggtgcactgaacaaggagctgtacattgaagattgcaacgattctgggaaccaccttgctgctggcgccattgttcgcccaggccgcgacgaccccggccgagccggaactgccggcataccagagcagcctggccagctaccgctgcgagggtggggtagaggtgcaggcggcgtacctgaacatcgataacggcgcctcgttcgccaccctgtattacaagggccagctgataccgatgcatatcgcccgcgcagcgtccggcgcgctgtatgtcgccgacgacgaacagaacagctaccgctggcacacccagggcgacagcggtctgttgagcttcctggaagccgaccacaccgccaaggaacagcaactgctcaaggactgccaggagcagaagaccgaggagcagtaacgcctggcccccatccgcctgtaggagccagcttgctggcgagaggtcggcacggaccctctggttttcgtgtcgaacgccagtccgtcatcgcgagcaatcgaacgtcgaccggctgctcctacagagggggggcggccattatctgcggttgaactgccgtcgaacggccagtgtctagtccaagacaagcctgtatcgatccagccgtggagatgtgcccgtgaacatattcgaagccctgcgcgagagccatgaacgccagcgcggctatgctgccgaactgatgcgcacctcgggggacagccccgaacgcagcgcggcctacgcccagctcaaggccgaagtacaggcccacgagacggcggaggaacgcttcttctacctgccgttgatggagcacgacaacggcgtcgacctgagccggcacgcgattgccgagcaccacgcaatggacgagctgatggaggcattggacgacaccgagatgtccagcccggcctggctggccacggcaaagaagctggtggacaaggtgcatcaccacctggaggaagaagaacagaagttcttccagatggccggcaagatcctcgacgacaagcagaaggaccagttggccaacggttatgtgaaggaataccggcaacagctggcggccgactgagacggccctcgaagaataaaaaagcccgcgcattggcgtaatgccgatcagttaaggccttttgtaagcgcgagcttgtctccgggcggcgttccgacgaagagctccagcacaccgcgttaaaccgggcaatacgcgttatcgttgacgtttttcgcgagcaagctcgctcctacagggtttgcgcattacttgtaggagcgagcttgctcgcgataaacccgtacacacaaacatcgaacctagcggttgaaacgctccaccagcgagtactgggtggtggcggtctgggtcagttccttgctcagttcggccgagtgatgggcctgctccgaggtctggtcggccagttgcgcgatggtgctgatattgcggctgatttcctcggcgaccgcgctctgctcctcggtggccgcggcgatctgggtggtcatctcggtgatgttggccaccgcctcgctgatgcccagcagcgcctggtccgcctccagtacccgggccacgccttcctcggcctggcgctggccgctttccatgctctgcacggcgttttgcgaggagctctgcaactgggtgatcagctcatggatctgctgggtggattgcgcggtgcgctgggccagctggcgcacctcgtcggccaccaccgcgaaaccgcggcccatgtcgccggcgcgggccgcttcgatggccgcgttgagcgccagcaggttggtctggtcggcgatgcttttgatcacatcgaccacggtgccgatctcgtcgctgtccctggccagttgcgcgacgttctgcccggtttcgccgaccacctgcgacaggcgttcgatggcttcacgggtatcgcgggccacttcgcgcccacgcccggtcaactggttggcttcctgggtggcgtcggcggtgcgctgtacatggctggccacttcctgggtggtggcggccatctggttgaccgcggcggacacctgctcggtttccacccgctggcggtccaggccacgggagctgtcgctggccagggtatcggagcggctggccagggcattgagctgttcggcactgtcctgcaggcgggtgaggcaggttttcagccgcgcgtcctggctgacgaaggcggtttccaggcatgcctgggggccgtgggcgtcgctgtacatctgcgcgatcaacgggtcgcaggtggacgagtcggccagttgcagcaggcgccgggcggcgtggttctggcgctgcatcgccagcagcgccaggggcacggaaatcccggcggccaccgccagcgccaaaggcggcgccagccagaggccgctcaggccaccggccaggcccgtggccaggaacggcgcccagcccagcagggccggttgccagcgatgccggcgggggatggccggctgcttgcggttgagacgctggtagaggtcttgcgcgcggcggatctgttcggcgctgggtttgacccggaccgattcgtagccgacgatccggctgccctcgaaaatcggcgtgacgtaggcgttgacccagtaatggtcgccgtttttcgaacggttcttgacgatgcccatccacggctggccctgtttcagcgccgcccacatatgggcaaataccgcgggggggacatcggggtgacggacgatgttctgtggagcgccgatcaggtcgtcgcggtcgaaaccgctgatgtcgacgaaggcatcgttgcagtagctgatgacgccatgggcatcggtggtggagatgagtttctggtttgaccctaaagccacttcacgttgtgtaacgggctgattgtttctcatttccagattgctccctgtgtcctacaaaatccatcggcacgagtcagaacaatcttagctaaatgttagaaaattccttgcataacaattagttgcattcccatcgcgaggaattctgaatactcccgagcggatggcacaggtcgttgaatctgttggggaaagtctggcgctggagcaggcccgggttggccggcgcgagccgctgacaacgcttatcgggcaagaaaccgcttcagttgccgtgggccccaagggcgtattgcaggacctgcagggcgtgggtcagccgggccttgcgtttgtcgatgatgcgcgggtcgccgtaacgctgcgcggcctcgagttccatctggcgcaatatcacctggtattcggcctggcgcaggggcgggttgtgctcgaagtgcagtccgtcgcaatagtcgctgagcggttccagcgcccgttgcaaaccggccagctggcgctgctcagggtcggccaggagtttttccaggctgctcttgatggtctcgccccggatcaggcaactgctggtggcttccggcggggccggttcggggtcttcctgggcgtggcccgtgctggctgcaaggccaaccagggccagcagggagagggcggtgagggcgttcatgaaggtccttgatacgacaggcgtgcggggcgctatcttcaagagccaacgcgcgccggaccatcagatacaactgaaaaagccttgggatatttctgtgttttccggtcggaccgggcagtgcccgtctcagcgagggccaagcatccgctcgatcaccgcccacaatcgcgggtcgttgaaatcctcgaccaccagatgcgcgccagcggccagcaacgcctcggggctctggctggtggccaggccgacggtgaagaccccggccccgaccgcggcggtcaggccggggatcgagtcctcgaaggccatcccggcctcggcgctggcgcccaggcattccaggccggtgaggtagggcagcgggtcgggcttggcccgcggcaattcctcggccaccagcacgctgtcgaagcgatcgcccagccccagcacgtcgagcatgtgctcggcattggcccgtggcgcattggtcaccacgcacatgccgatgccgcgttcccgggcgaaatccagcaggcgcaacaggcccggcatcggcgtcagtcgtggcgacagctggcgaaagcgcacttccttgcggtcggcgaaagcctcgtgctcggccaccgagcgctgcgcaaacaggtagcggcacatattggcattggcctggccgctgacatgggccgcgaactcttgctgggtgaacacccggccttcttcctccagcaacaactgctgcaacgccagcaggtgcagttggtcggtgtcggtcagggtgccgtcgagatcgaaaagcagggcattgagcatggcgcgattcctgtcggggccggtggctgaagcggttaagccaggcatcgtagcagctgccgaggggagcgctacagcctttgtctgggtgtttgcagtgacagcagaggcggcaggagggcggaatttcgctggggccggtcggcgcaaggtgctcaaggctggaaagttttccagcccaggcagataaaagaagggaggtctatttagacgaggaaattattgaattgccagacatctgtcgggtcgttgatggcaaaggtgcctgggtcattcttcagcgggttccaatcggagaagaagccttgcaacccacccaaataaggggccgcatagccaagtacttcttgatagtccatttcttcagcttctaccattcccgcattcgggtggttcagggcccatagataacccgatagaacacccgccgcgacttgcagggtggtcgcggtattcaacggcgccaactcccttgcctgatcgatggagagcgtcgagccataccagtagcaacttttctggtgccccatcaacagcacgccaagatggtccgagccgccggagatatcttcggacttcaatacgcgcttgagtaaagggtctttgcggcttttacccagccattccatgagtgaaagaatcgcatggtcacagggcctgtaggcgtagttgacggtggggcgataggcttcgtcggcgaaagtgccgctcaggaactctgctatggaaatcgcttcgttatgggtaaccaggaagcccagggtttcctgatcgtagggcgtccatgttttcaactgcaccgtcgccccgggtctgcctatataaatggcggccttgctcccggattcatgttcgaagccctgctcgggaagtgtcctttcgtgggaaccccaccccaactccgcgggttgttgcgcttcgctgataaagccgtttaccgaccaggtgttgacaaactctccccgggccttgggttcgacggcgacctgggaatcgtattcggcgatatgaataactttcacccccagttccttgctggtgcgggcccagtcttccttgcactggggcggtgtgaaacctggggtgaggtcattggccagattcaccagggcctgtttcacgaagtgggagaccagcccgggattggcgccatgcgcgacgaccgccgtcggcccgccgcccaggcgctttttcagtttgagcatgcgctcacgcaggtggtagttggtgcgctgggccatgggctgcccggggtcgctgtagccgcctggccaaggctcaatgcaggtgtccaggtacagggcgccggcctcgtggcagacctcgatgaggtcgaggctcgagacgtcggttgaaagattgatgagaaagctgtcccgctcgacaaggggggtgagtatgtcccggaggttgttcgggtcgaggtgggcctgaatgaagttcaggttgtacctgctctggaagaagtcctggcgctgcgggcgtaacggatcgatggcgaccagctcgatactatccagatcgtgagttttactcagtagtgcaacgaacgattctgctatagagccaaagccgacaaatattatttttctgggcgcaataagggcattcattcgcaggcttccttgccgatgctgtgtttattttttaatagacaggaggtgtcggggtattgtcaacaacgaatctgtacgaacagggataattaaacgttagaactttaatcgtgaatatcgagttcgaaaactcacggaatggttaattagttttttgcaattaatggagctgccgctgaatcgtggaaattgtcgagatgtagttaaaatgtaatttgctttctgtgtccgggaaaaattcttgacaggggaaacatattgatcttttatggggtcctgaactttccaggtggatttaaagttcggcgatgcaacggatgcattgttattgtctggtgccgcagcgcaccgtactcataaggatatgtgtatgttcttgaccctctttgtccgctctatttattaccttcccgaatctgctctcataacgagtccataagtctgtcattggctttttgcccgatcctgcctgacgcccgtcatcttctcctggtggatgttgtatagcgttgctcgatcgttggcaggactcgtcaattatcactgttgttttcagtgcgtcatgtcttggcgtttgaaatttaatattccattaaaatttattggggtgtcactgtgtcggaacgaattaaagtagttatttccggggctgatcgtttggctcaacgctatatctctaagttgaatccctcgcagtatgaggtggtgttgattggcgagtcgtttcccgatcaggcacgggttatttccgctatcagcgacgcccacatctatatgcacgccggtgaagagatcctcaccgaagaggttctgcaacaggctggaaagttgcagctggtggcctgcctggcttcgggtgccgagcacctggtcgatatcgaggcggctgaccgcctgggtatcgcggtgaccaataccccgggcttgaaagtgatgtatgaagccatgggcgagttcctggtggggctggtcattgccttgcgccgcaagttgatctacttccacaccgagcagaaaaatggccgcctgcacgaaacggacaccccgctgctcaaggatgcggtgatcggcatcatcggcatgggcaaggtcggctcgcgggtggcgaggatgatgcacgatgccttcaactccaggatcgtctacaccgccaactcgcaaaagcccgaggtagagcgcgatacccaggcgcaacgactgtcgctggacgcgctgctggaaaccagcgacgtggtgatcctggcgtgcccgtacaacgactcgaccctgggcttcatcggggagcatgagttgtccctgatgaaacccagcgcgatcctgatcaatacctcggagtcgtccctggtcgatggccaggcggtctacaaggcccttgtcgaggagaagatcgccggtgcggcgttcgacgacaagaactgggatgccccgccgctgatcaaggatggcaagaccctcaacatgccgatcgagatgctcgacctgccggatgatcgcttcatctgtacgccttatgtcggcgccatgacttcggcggtgtgggacgagatggcgagtgtggccgtggggtcgatcctgcacttcatggagcagggcaccgacaagaatctttacaaccgcaacctggacgcgacccgccacgcccggcgcatgggtttcggttcgccgcttgtcgcagcactggaaggctgagccaggatgaacgacgttaccacgcaaacacgtctgcgacaggcgctgcaggggtatgaggcggtcgagctgcttttccccggggagcccggttacgaggaagggcgccaggtctataaccggattcacgacctgcatcccttgctcatcgtgcgtacccagaatcgcgcggccattggcgcggtgcttgagctggtggccgataacgggctggaactcgccatccgcggcggagggcatcacattgccggtttcggttcgaccgaaggcggcgtgctactcgatttctctggcttcaacggcgtccggatcgatgtgcttcagggcattgcccatgtgcagccgggggttcgcttgcgagatatagacgcggccctgtgccctcaggggtatgtggtgccgaccgggacggtcagcgataccgggattgccgggctgacgctggggggcgggatcggctggttcgtcggcaccctggggtttacctgcgacaacctggtcggcgccgatgtgatgctcgccagcggcgaggtcgtcagggccgaggacccgcagcaccaggacctgctctgggccctgcgtggcggtggcggcaattttggcgtggtgctggagtttcgttatcggttgtcgaagctgcccaaggtctactgcggctcgatctcggtggctgcccaggatgttccgcgggtgctgatgcaactgggcaactacatggagcaggactgcccggcgaacctggtgttggcgccggtcttcagcccgagcgcggatagcgggcgctgcgtgttatcgatcgatttctgcctcagcgactatcaggacctcggcgccatccgcgcattggaagaggcgctggatcttgcaggcagccaccagtacgtcacggatgacttcagggcctggcaggcctggttcgacgacaggttccagccgccgatgcgcgggtactggaagtcgatttgcctggacgattttaccagcggcaccatggatgccttgctgaccgcggcgtccagcatgccgggcaagcgctgcagtatcaccatcgagcatttgaacaaaacacgacgttcggcagcgcctggtgactcggcctttccgctccaggcgagaggctacggcattctgttttccgcccgctggagcgaagccggggacgaccaggcatttatccactgggtcaaggcggccgcgctggaaaccgcgggtaatgagggcgccgctgcgtattccaactactcgtttgccgagagcacctcgcgtgcggtcttgctcggcagcgataacgagcggctgctcgaggtcaagaagcgctacgacgcgggcaatctgttccggcgcaaccacaatatccgcgcgagccaagaaggtgcctcctcactcggttgattgagggaggagggaagcaggaccgatacatagggggagaatgcccggtggcttgggcgccaactacttaagttggtagtcgtgagttcgagtctcactctcttccaccatttttgcccgggcgtggtggcttcacgcccgggagcaggaccgatacatgggggagaatgcccggtggcttgggcgccagctatttaagttggtagtcgtgagttcgagtctcactctcttccaccatttttgcctgggcgtggtggcttcacgcccgggagcaggaccgatacatgggggagaatgcccggtggcttgggcgccaactacttaagttggtagtcgtgagttcgagtctcactctcttccaccatttttgcctgggcgtggtggcttcacgcctgggagcaggaccgatacatgggggagaatgcccggtggcttgggcgccaactatttaagttggtagtcgtgagttcgagtctcactctcttccaccaattatcagaaggtcggcttgttcatttcggcgagagatcgatcgagcggctggtggctacactctatttgttgtgtgtgctgaattaaatcaaggatgcaggtatgcagtggattgcagaaggtcggcgcattatcaaagtggcggtgccgctttcgatcgtttatttgatcgaaagcatgatggccttcgttgactccgtgttcatggggcgttttcgtgccgatgaaatcgccggttatggcctgggggcgcgtatcgttttcgatgcgaccaatgtcatctgcctgtgcgtcatcggcatggtcgcggttttctccgccaagtacgacgcgctcaaagacaagcgggcggtggaagcgcatgtgcagcacggcttctatatgtgcctgctgctcagcctgccggtggtcctggtgaccttgaaccttggcagtctgctgatggccttcaacgtcgacgcggcggtggccctgcaggccgatcagtatgcgcaaggcgcggtgtactcgatcttgccgctggcgttgttctgcgtcttgcgggaccactcggcggcggtttccgacttctcgtcgattttctacatcacgctcttcgccagcgttttcaaagcgttgatttcctacgtgctgatcctcggcgagtttggttttccacggctgggtgcgtacggcgcgggcctttcgacgtccctggtcagctggggcatgctgggcgcggagatcctgctgtattccctgagcaatcgccggtccggcaagacgtacgcgatcttcaccggctgggtcagcctgcgctgggcactggtcaaaaagtacctggcgatgggcctgcccctctcggcgaacagcctggtcatttcgttgatgttcatcgtgctgatgctctttaccgagaaagtcgggaccctggagctggccgcggcgcaactggtgttttcctatatctacccggtcttcatgctggttgaaggggtgcgggaagccatcgccattcgcgtggctcaggagcatgcgctgggcaacgtgcacaaggtgcgcaagctgacggtggtggcttgcctggtgagcatgctgtttctgtttcctttcgcctttgtggtctttttcgattccacgctggtcgcctcgatgttcttcaacgtcaacgagttggcgaacattggcctgctgacccagttcaacctgatcgtcggcctggccgccctgagcatcgtcgtcgagtgcgtgcaggtcatcgtgctcggcgcgctgaagggcctggaagacaccaaggtgccgttcctgatcaataccaccaccgcctgggtgatcggcgtcgccgggggctatcacctgacgttcaacctggaccagggggtcgtcggcctctgggtggcgctgattctcagccatctggtgtcgctggtgatgttggcggcccggctgctgctggtcaccaggcccaacagccctttgttgtgcgcgacctcggtgcacgactgacggttacccatcgccagaccggtcgaacccggcctggacacccaccatcaaggttttcggaagatcgccggtctgtacgggggagtgcgtatgcgtgaagtactggctacttacattgaggcttatgacgtcgcgatcgattgcctggagcgttggcatggcgccgagctggcgacggccgtcgatcaattgttgtcgcggatcgcggcctgtgacgatgtgctggtcaacaacgtgctcaagcaccatcgtcatgtactggagctgaacagcgaggaatgggcgtggttcctgcccggtattctcgagctggagcgcaacagcgcctttgtggcggcctacctgatcgagaagatcccgctgctcaagcaacagctggatatgcgggccttcgtcgagttcctgctcgccatcaaggatcattcggcgcgcggcctgtcctacctgatcggcactgccgattcggccctgtgtgacgacctggagtcgatcctggaggcggtaggcactgcctattatcaggccgccatggactgtgtgctgcgccacaaggattcactcggcgcgtgctgcgcgcccttgctcatccatatcaagaactacagccggcacctgcctgccaccgacctggacgcgctggcggccctggtctgcgaggtgcacgcccgctacggcagtttcggcgcggtggccctgctggaaaacgccgatggggtatttgcccggcacagtgtccaggcggtgcgtgaacgcctggacgaactggccgaggccagcgtcgattatttccattacctgcttgccaatggcctgccgcaggtcggcgcggtgcgcgccgacacggctacggtcgagcaactggacggcgcgagcctgacctcgcatatcgatgccccgggggtgttcgatggcgggctggtctcggcgatcatttccaacatgaacttcatggacccgaagaccctggagaacatgcgtcatcagttgtcgatcgatgatttcaaccgctggttcgaacagcagcccgcgttcgccaatgcgcgcatgcagatcgccgatgcctatgccggtgcctggttctcgccgttcgactactggggtggcgaaatgggcatcgcccgcttcaggacgctgataggccaggcgatcgaggtgagctacgacaagcaggcccggcaaaccctggtctaccagaacaaggcgctgttcgaccggcatgccgagtacagcgaaaaccgcctgcgactgatgatcgatgcggcgtttccccagggcggtgacggatcgccgatgcccgaggatatcgccagtatccggacctatctggacgaccacgatcgccaggctttgcgtgatcggcagtccaggcagcgggtgttcatcagcacctggaacaggaacccctggcaggactacagccgctccgacgagttttactcctgcaccggcattggcgattacgccgtcaacaatgccccgggttacctggtcgaaccgaacctgtgccggctgtatgtctggtaccaggggcgacgcatcggccggctcaacctgattgccgtggcggatgtcgaggggacgccgggcctgttgctcgatggcgtcgagggtggcggtcgcctgttgcagtcggaagaacgggtgatggacatcctcggcagtgtcgccgggttcgccaggcgttgtggcctgagtgcctattacatcaactgcaaggccacctacaacaatgtgcccaaacagttcatagcccaggcgattcgtcatgtcgggctaccggtgacgcctgcttacctacgtcgctattaccaaggaatggaaatctatcaggcgatgccccacggactcataccgttcttcgaatccttcgggaacaacctgtccgggatcgtgagcggcctgaaaatcacgttgccctaggggtcaacgttcacaaggaggtgttatgtcgactacattgaccgatcacgagtacctggccctgaactcagcctgcagcttcgctgacgggcacgcctatcacgagttgccctgcgggctggagggggtcgtcgagcaactgccgaacatttggtatgactgcaatcaaaccaaggttcgcgacatggagaagtctttcaagtgtgagtgggccaacctgctcgattccagcgagttgttgcgccacgagcacttccgggtttccccgaccgcctcgaactccatcgatatcgtcgcgacactcctggccgagcgggccccgcgggtgctgctgatcgaaccgacgttcgacaacctgtacctcatgctcaagcgccgcggctgcgaagtgtcaccgctgaacgagcaggcgatgatcgacgccatcgaccaggataacgtggccgagctgctggacgggcatgcgttcgataccctgttcctggtcaacccgaacaaccccaccgggtacctgatccgcgagaaacagttcaaggtcatcgccgaatactgccagcggcgcaacaaggtgctggtggtggactcgacctttcgtttctataccaggcaacccttcaatgactatgccgcgctgttgaagacgggtggctcgttcgtggtcatcgaggacaccggcaagacctggccgacccaggacatgaagtcgagcatgatcgtctattccgaggacctggccgcggggctggaaaagatctacgaagagatctacctgtgccattcgcgttttgtcatgggggtgttcgtcgatctgttccggcgcacggcggcggtgggcctggaacaggcgctggtgcatgagatcgggctgcgcagcgccaaggtcagggcattgctggccggtaccgatctgcgctgcattaccgacagccgcgcgacggcgatgccggtggagtggatcgatgtctcgcgcaccgggaagaccgacgcggagctgatcaagcagtttctgcgccacggctttcattgcctgccaggcagccactttttctggcacgcctattacgaacgcggcatccagagttcgcgcttcatccgcatctcgctcgcccgtcccgcgcaggtcttcgaaaacggcctgacgctgttgcgcaacatctgccatgaatcgaacctggccaggctggccgtgaacggttgagtcatccccctgcgttcctgctggtggcggctcattcatccgcagggcccagcaggcctttctcatcttttttgtgagtcccgatcgacggcttcacaaaaaagatgatttctggtgcctccttggcgagctccagaaccctccattgcgcggcccggcacccgccgccggcgccccaagccccatgccctgcgaccgccgccggcgcctgtacgccacgggttcggccaggctcccgtgggcgtccttcctgtgcttagctttcaggatcctgctgttctcgcggggcgtgaacgggtctcgtctcagagtggaacagttgtcgcgaaattaaacgcggccagccggcgattgcctgggagatgcgtcctgcagcttcagcaagtccttgataaaacacatcatttgtaagctggcacgctccgtgtattgctgacttcagacgtttctcttgcctccatgcccggcgcgacgggcatggcagaaaccctgaaaacgacgcacgacaataataaagctcgctaataaaaagctccgtggaggtccgaccttgatcaagagaacactccgagcaggcacgtccagcggcctgctggcgctggcggtctgcgccgccttgcatgcccctcccagccttgccgcgcgcgaggcccaggccatcctcaaggaaacctgccagggctgccataccccggaaacggcgggcggcctgagccgcatcagccaccagcgcaagaccccggaaggctggctgatgagcatcgcccgcatgcaggtcatgcatggcctgcagatcagcgacgacgatcgccgcaccctggtcaaatacctggccgatacccagggcctggcgccgagcgaaaccgacggcgtgcgctacgccctggagcggcgcctgaacaccgtggaaaaattcgacgaacaaaccagccagatgtgcggacgctgccactccggcgcgcgggtcgccctgcagcggcgcccggcccaggagtgggagcgcctggtgaacttccaccttggccaatggccgtccctggaatatcaggcgctgtcccgcgaccgcgactggttcgacctggcgcgcaaggagatggtgccgctgctggccaagcgttatccgctggacaacccggcctgggccaaatggctggccagcgcgcccaaggccgagaccctggtgggcgactggagcttcagcggccacctgccgggcaagggtgagctggccggggtgatgagcgtcagcgccgatggcaatgacaccttcaaggtcggcatcaagggccagtacgccgacggcagtccgttcaacggcgagggcagcgcgatcctctacagcggctacgaatggcgcggcaatgtcagcatcgacggcgtgagcatgcgccaggtattcgccgccaaaggcaatgcattgcagggccggatgttcgaggccgagcacgacgagcgcggcctggacttcgtcgccgccaagcagggcagcagccgtttgctggcggtgcagccgggttacctgaaggctggcgccgaagccgaagtcacgctgatcggcagcggcctcaccggcaagccgaacttcggtaaaggcgtggaagtgctcgaagtcatcgagcagagcgcggagcggatcaaggtccggctcaaggcggccgccaatgcccaaccgggcctgcgcaacgtcaccgtcggcacgctgaaaggcccgacgctatcggtctacagcagcatctccgaagtcaaggtggtgccggagttctcggtggcgcgggtcggcgacggcggcggttcgacgccgaaagtccagggccgcttcgatgccgaagcctggggcaagggcaccgatggcaagccgtatcgcatcggcgtgttcccggcgcagtggaaggtcgagcccttcgacgagcgcgccagggaagacgaggacgtcaagttcgccggccagatgcaggccgacagcggcgtgttcactccgggcgatgccgggccgaacccgcagcgcaagatgtccaccaacaacgccggcaacctcaaggtgatcgccgccgtcgacgacgcaggaaaatccctgaccggcgaaggccacctgatcgtcaccgtgcaacgctggaacaatccacccatcccttaaggcgcggtccgtgactgacgacaccctttcggaatgaccgcgggccctcgcaagaagggggccggcacaggaggtttgcaatgggcgctatcttgaatctggtcgaacgcaacctgcacgaagtgcaggtcgatgccgaccgcatgctgttccatatccccagcagttcgctgttcgccagcgatgccttgaccggcagcatcatcgatgccctgcgcgggccgggctgctcctccactgagctgatccagcggctggccagccagtacgacggcgaggaaatcaacgaaaccctgcgcgagctgatcgccctggaactggtcagcgacggctcgccgctgactgaggaatggaccgtcaagcgggtcgagcgcacggcaatcaacaccgtggtgctcaacgtcaacaccggctgcaacctgagttgcacctactgctacaaggaggacctggacaagccctcggcgggcaagaagatggacgtcgagacggccatcgcctcggtggaaatgctgctcaaggaatcccccgacgaggagcgtttcaccgtggtgttctttggtggcgagccgctgagcaaccgcaagctgatcgagtacatggtcgactattgcgagcagcgttttcgcgaggcgggcaagttcgtcgagttcgtcatgaccaccaacgccacgctgctcaccgaagagacggtggactacctgaatgcccaccgctttggcttgtcggtgagcatcgacgggccgaagaccgtgcacgaccgcaaccgcatcaccgtgggcgggcagggcacctatgacgtggtgcggcgcaaggcgcagatgctgctggcgcgctacgacagccgcccggtcggcgcgcgggtgacgttgaccaccggggtcaccgatgtggaaaccatctgggaccacctgttcaacgaactgggtttcgccgaggtcgggtttgccccggtgacctcgggcgatatcagcagcttcaacctcacaggcgaagagctgatcgaagtcttcgccagcatgaagcgcctgggccggcgctacctggaggcggccctggagcatcgcaatatcggtttctccaacctgcaccagttgatcaccgatatccatgaaggccacaagaaggcgctgccctgtggcgccgggctgaagatgctggcggtggaccacaagggcgagctgaacctgtgccaccgtttcaccggctcatcgctgccgaccttcggcaacgtgcgcgagggcggggtgaagcagatggagctcaacgacttcctgtcccagcgcctggaccgcagcaacaccggctgcgacagttgccgcatccgcaacctgtgctccggcggctgctaccacgagagctacgcccgctacggcgacccggcgcacccgacttatcactattgcgaactgatgcgtgattgggtggatttcggcatcgaggtctacagccggatcatggcccgcaaccctgcgttcatcagcagttacatcactccgcgcaaggcccactgacatgaaacatctcaagccgatcaataacaaagcccagaagctggaacaggccgccgacgagaaccgtatcgaagaagtggtcgccatgagttcggtggccggttgtgcctcgaccaccgacccgggctgggaaatcgatgccttcggtggcgtgtcgtccttgtgccagccgatggaggccgacctctacggttgctccgacccttgctggtggccggcccaggtgccggacatgatgagcacctaccccgactggaacaaggacgcccaggcctccaacgagaactggcgcaacctcggcaccgtctttcccaaagataaatagcctaaagacaagtaatcggtcagtagaaggattccagcatgcgcttgatcaatgtctgcggcctggccgcttccgccgtcctgggggcctgttccctcagcgtcctggccgatgacaacagtgacaaggccctcaacgccggccatgaatacatggtcaccaccaactacccgaacaacctgcacgtgatcgacctggccagcgacacgctgtacaagacctgcaagatgcccgacgccttcggccccggcaccgtgcagctggcgccggaccgcaaggtcgcctacgtgctgaacaaccactacgccgatgtctatggcgtcgagctggacagctgcaagcaggtgttccacgccagcatcacccagcagccgggggaaaaggcgcgctcgatgttcgccttcaccgtcagccacgacggcaaggagctgtacaccgtggccaacccgacgctgatgctcaacgaccgttatgaggtcaagccgccgcggctggatgtgtatgccaccgacgccgggctcaaggccaagccggtgcgcagcttcccggcgccacggcaactgaccatcatgcagagcggtgacgacggctcgctgtatgtggccggggcggacgtgtacaaggtcgacgtcaagaccggcaagttcgatgtgctgatccccagccgccactggaaacgcccgaactacagcgcgccggacgtgctctacgtgtggaaccagcagacctggcgccatgatttctcgctgctctacaccgccgccaagttcaaggataagaaacaggacccggccactgccgagtacctgtacggcctgttcagcatcgacttgaaaaccggcaagagcgaaaccaccgacttcggcccgctgacggaaatctacttcagcggcatgcgttcgccgaaggacccgaacctgatgttcggcgtactcaaccgcctggccaagtacgacatccggcagaaaaaactgctccaggccgccaccctggaccattcctactactgcatttcgttcaacaaggcgggcagcaagatctatctggccgggaccttcaacgacgtggcgatcttcgatgccgacagcctgaagcagatcggcaatatcaagctgccgggcggggacatggcgatcaccacggcccaggtgttcgagcgctagccatcgcgagcaagctcgctcctacaggaacggcgacgccctgtaggagcgagcttgctcgcgaaaaatctaaagatcgccgccgattcaattccccggcaccgggcagccgaggtcgccttcctggcacttgaggtaggtcttgaacgcctcgacccgggccttggtcaggtcggtggtgcagttgctgtagatcaacggatagacgctgccaccggccaccccggaggcggcgaacccgcattccgcatcccgaaaagccacccaggcgcgctgggcgccgaccagcagcttcttgccgtccgggttgtccttcaggcgctgggtgatgcgctggtagagcgtattcagttccttgtccgccgccttgtgctgctcggcggcacactggttcatggcggcctgggtgctggcattggcacagtcggcggcctgggccagcggggtgagcagaaggggcgccagggccaggaaaatgcgtgagttcatggtgattctcgcgatggacgatcaagggggcatcaaggacgttttgcgggccgcccggttctggttggcgacagctctttggcctgcatcctagccctgacgacgaccgcgtgtccgtctttgcggaaaaatgcaacttaaaggttgctcttctgccagggcgagctagggtttgatcactggaggtgacccatgaactcatcagatcgcatcgaaagaaagatcctgctcaaggcaacccgttctcgcgtctgggccgcgctggcgaatgccgaggcgttcggcagctggttcggcgtggcgctcgcgggccagcgttttgtcgtcgggcaacggacccgggggcagattacctatcccgggtatgaacacctggtctgggatgtgctggtggagcggctggagcccgaacatctgttcgccttcagctggcacccgtacgcggtggagccgggcgtggattattccgccgagcccagcaccctggtgcaattcgaactcgaagacctggacggcggcactttgctgcgggtggtcgagtcgggattcgatggcattccacccgagcggcggctcaaggcgtttcgcatgaacagccgcggctgggacgagcagatgaacaatatcgagacctaccttggcccctgatacttcttccccatccctgctgccggcggcggcatccctggacggctcggccatgatcttcgcggcactgggcgacgagacccgtctgcggctcgtcgccatcctgtgtggcggcggcgctatgtcgatcagccagctgaccctcggcaccgacatcagccgccaggcggtgaccaagcatttgcaggtgctggcgcaggccgggctggtgcgcgacgccaagctggggcgcgagcggctgtgggcattcgaaccgggccggctggccgaggcccggcgctcgctggaggtgatcagccagcaatgggatcatgccctgggtcaattgcaggcctttgtcgagtcataacggaaagagtcacggatgttcgagttttacctgaaacgctggaacctgcaggtcgatggcgcacccatcgtcacccctggcagtcacctgttgccggtgcgcctggacgatgcgccggcgatgctgaagatcgccctcgacgacgaggagaaatacggcaaccgcctgatggtctggtgggccggggagggcgccgcccgggtctacgcacaccacggcgatggcttgttgatggagcgggccatgggtcggcgctcgctgatgcagatggccctggccggcgaagacgacgaggtcagccggatcgtctgcgccagcctggcacgcctgcatgcgccacgcgcgacgcccttgccgccgctgttgagcctgcaggaatggttcaaggccctgcgcccggccgcccggcgcgagggtggagttttcctgcgctgcctggccacggccgatgaactgctggctacccctcgggaacaggtggtgctgcacggcgatatccatcacgacaatgtgctggacttcgaggaacgcggctggctggtgatcgatcccaagcgggtcatgggcgagcgcggtttcgatttcgccaacctgatctgcaacccggacctggcgaccagcagcgaaccgcggcgcttcacccgccaggtcgaggtcatcgcccaggccgccgggctggagcgcaagcgcctgctgcaatgggtgctggcctataccgggctgtccgccgcctggttcctggaggacggcgacgtacccagcgcggaacaccaactgcaagtggcggaattggccatccacgctctggaaggcgcggcctaggggttttggcaggtcgatctatggcgaaaggcttacatgcgctggctgctatctcgcctgtcgccgattgggcgacaggcttaatcttcacccaccaactgcagcgcaggacgcgctcagggtcatggatgaccgaccatgtgcaaggatgcagcgacaggatgtcgtaatggtcttgaagaaaccccgcttcggcggggttttttttcgcttgtggaaaagctagaggtggcgggtttcctccggcacgttaccccagttgtcatggcgcccgtcggcatagtgcaccggggccgcaagcagttcctgcaggtcgatgtcatccagggtcatcacttgcaccgcgacatagtcgccgccgatctcctgcacatgaccgcgcccgaaggggcgcacgccgcaatgcttgcagaacagatgatgggtattgccgctgttgaaccgatagtcgctcagcgcctgttcgccactgagcaggcgaaaggccttgggggcgatgatcgcgttccagttgcgggtcttgctgcagatcgagcaattgcacttgttggtgccctggctcaagtcgatctcggcttcatagcgcacggcaccgcaatgacaactgccggtgtaagtcttgtgcatggcaaggttcctgagggaaggctgggccagagtgtagaagctgcccgaacattagcgggaaaactttttgattaaggccagtagccagtattgaatgtgccctgcttaaataaaaaaagttccgataagagcatgtaagttcgtccgttgggtagcgtgaagggcctaccagagttggtaggtttacaagcgtccgattgcagatacagtttcaaccagaagacgggttctgtcccactacaggttctttctgtcaaaaacaggcagaaagtatttgtcatgcggggtgggcgatttccggtttcagttcgtcaccaggccactgctccgggtgctgctgtttttgtcgtacatcctgttttgttttttaagttcgaccagccacgaatacagtgcgcgtctttttcgtcgtgcccaacttataaaaactgccttttatgctgaagttcacattcaagtgaatctctggcgtgtctgtgtggttgaaaagccaaaggtccccgcacttatgaaacatgttcttgtggttcgttattcgcaaagcggtcagttgaacgacgtggtcgaaagcctgatctcgcccctgcgttcgacgcgggaggtcaaggtgcatgagatggtgctcaagccccgggtcgcctatccgtttccctggccagtgggccggtttttcgacgtgtttcccgagaccgtgcagctcagcccgccggccatcgaaccgctgcataccgatcatcccgggcccttcgacctggtgatcctggcgtaccaggtctggtatctgtcgccgtcgccgctgatcaccgcgtttctccagagcgcgcaaggcaagcgcctgctggccgggcgcccggtggtcacggtgatcgcctgccgcaacatgtggctgatggcccaggaggcggtcaagcgtttgctgcacgaggccggcgcgcggttgcgcgacaacgtggtgctgaccgaccgggccaataccttcgccaccctgattaccacgccgcgctggatgttcaccggcagccgcgagtcattcctcggcctgcccaaggccgggatcagcgccgaggatgtccagggcgccgcacgtttcgggcgggcattgaaggccgccctgcaggccaataaagagcaagccgacgggccgatgctggcagggctgggggcggcgaccgtcaaccccgggctgatactcagcgagcgggcggcctataaaggcttcaagttctggtcgggaataatttgccgtttcggcaagtatgggcaatggctacggcgactcttgctgtgcctgttcatcgtttatctattgttggtcatcttgactgtcctgcctgtttcactggtgttacgccgtttgcttcatccctttgtccgggcgcgtctcgataagttacagcgttattacgaacagtcgtccggttcgcaactaaatcttgaatccgaagggtgaaatcatcatgagtgaattgtttgtctatatcacgaaacatccacttatatgccgggagaggcagtggataacgatacgatggagagcattctcgggtatgtgggcgggcgaccttcacggtctcggcaagtagtgctgcgtaataacggaatcaagcagcgctattatgtgctggacccgcagaccggtattccccgtttcactaacgcgcaaataaccgccgaggcaatcaagggcctggtgggcgacggctttaccctggacgccatggaatgcctgtccaccggcaccaccatgccggaccagttgatgccaaccatggcgtgatggtgcatggcgaactgggcaacaagccttgtgaggtggtgtccaccgccggcatctgcctggcgggcctcaccgcactgaaatacgcctacctgtcggtgcttgcgggggccagccgcaatgccgtggccaccgcctcggaggtgccttcgccggtgctgcatgcgcgtaatttcgatgcggaaaacgaggcgctggtggcgcagatggcagcccgcccggaaatcgccttcgataaggatttcctgcgctggatgctgtccgacggggccggggccttcctgctcgagaaccagccacgggccggcggtctgtcgctgcgcatcgactggatcgacatcttctcctacgccaacgaattgccgacctgcatgtacgccggcgcggaaaaggccgaggacgacagcctgatcggctggaagctgctgactccggaggagtgggcctcgcgctcgatcttcgcgatcaagcaggacgtgcggctgctgaacgagaacgtggtgaagtacaccctcggcaagccgctcaaggaggtgatgatcaagcgcaatctgtcgcccgaggccatcgactggttcctgccgcacatgtcatcggaatacttccgcaaaccgattgccgagtgcctggaaaacaccgagctggcgattccccaggagcgctggttcaccaacctgtccgagcgcggcaacaccggctcggcgtcgatctacatcatgatccatgagctgctggagtgcggacgcctgcacaaggggcagcgcgtgctgtgtttcgtcccggaaagcgggcgcttctccggcggcttcatgcacctgacggtggtctgacgcgcctcgccaaggcgcaagaacccggtggccggcgtgggtcggccactgtttcgtggtacgcatccaactgcaagggaatgaacatggaaaacctcgaacaacgcgtgaaaagagtggtggcgagcgaactggccgtcgacctggcgcagatcggcaaccaggactcgttcgtcgagaatctgggagcagactcgctggcccgggtggaactggtgtcggccctggaggccgagttcgacctcacgatcccggacgacgcagccgatgacctgcagaccgtgcagcaggtgatcgactacctccgacaggccagtgagcaagcagtcccggcctgacgccggttcatcgaagatgcggtcagggctcagctggccgataaggttgctctggtccgcatctttcttcagcttctgtaagcgtcgtctcaggcctgccgccactgcgccacgaccctgtcgacgatctcgccgcgctgctggatggcgttcgccgcgagccgctgggcttgctccaccaccgctttgggcgctgtctctgggctaccggccgtgaaaggtggagccggggcgtactccagttgcagctggacccgctgcgccgttgcatcgccgaacagttcgccggccagggtcagggcaaaatcgatcccggcggtaatcccgccaccgctcaacaggttgccatcgcgcaccacgcgttcctgtaccgcgatcgcccccagcgcctccagcaaatggtggtaggcccaatgggtggtggcgcgcctgccccgcagcagcccggcggcgccaagcaccagggagccggtgcacaccgaagtgacataacgcgcctgctccgcctgctggcggatgaagtcgagggtctgcggatcttccatcaacggcccgacaccggcgccaccggggatgcagatcacgtccaatggcgggcaatcggcgaagctggtggtcgcctgcagcaccaggccggtgctggcggtgaccggcccgcgcgccttccagaccagatgcacctgcacgtccggcagcgacgcgagcacatcgtaggggccggtcaggtcgagttgctggacgttggggaacaacaggaaaccgatctgcagcgtcatggggtatctccctggagaagttcgaaggtgtccgctcttatgcggctggacggttcgactctagcgccctaggctttggcgaatacgccaacctgcccacgatttacgccaatcatgccccataccgccagaaccgttcatgtactgactttcgccaacgcccaggtactcgacgtcacgggcccgctgcaggtgtttgcttcggccaacgacctggcgcggcataaaggcctgccgctgccctacgcggtgaatgtgatcgccgcgggcgacggaccggtgaccacttcggccgggctggcgctgctggccgagcccttgccggcgccgggcacgccttgcgacaccctggtcatcgccggcggctggggcgtgtacgccgcggcggaagatccggcgctggtggcctgggtccgccagcaggcggcgctggcgcggcgggtggcgtcggtgtgcaccggggcgttcctgctggccgccagcggct
